US010760086B2

(12) United States Patent
Ader et al.

(10) Patent No.: US 10,760,086 B2
(45) Date of Patent: *Sep. 1, 2020

(54) METHODS AND COMPOSITIONS FOR WEED CONTROL

(71) Applicant: Monsanto Technology LLC, St. Louis, MO (US)

(72) Inventors: Daniel Ader, St. Louis, MO (US); John J. Finnessy, Des Peres, MO (US); Zhaolong Li, St. Charles, MO (US); Mahak Kapoor, Chesterfield, MO (US); Ronak Hasmukh Shah, Jamaica, NY (US); Nengbing Tao, O'Fallon, MO (US); Dafu Wang, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/217,775

(22) Filed: Jul. 22, 2016

(65) Prior Publication Data

US 2017/0016012 A1    Jan. 19, 2017

Related U.S. Application Data

(63) Continuation-in-part of application No. 13/612,985, filed on Sep. 13, 2012, now Pat. No. 9,416,363.

(60) Provisional application No. 61/534,086, filed on Sep. 13, 2011.

(51) Int. Cl.
  *C12N 15/82* (2006.01)
  *A01N 41/06* (2006.01)
  *A01N 43/84* (2006.01)
  *A01N 57/16* (2006.01)
  *C12N 9/02* (2006.01)
  *A01H 3/04* (2006.01)

(52) U.S. Cl.
  CPC ........... *C12N 15/8218* (2013.01); *A01H 3/04* (2013.01); *A01N 41/06* (2013.01); *A01N 43/84* (2013.01); *A01N 57/16* (2013.01); *C12N 9/001* (2013.01); *C12N 15/8243* (2013.01); *C12N 15/8274* (2013.01); *C12Y 103/03004* (2013.01)

(58) Field of Classification Search
  CPC ........... C12N 15/1137; C12N 15/8275; C12N 15/8277; C12N 15/8278; C12N 15/8274; C12Y 103/03004
  See application file for complete search history.

(56) References Cited

U.S. PATENT DOCUMENTS

| | | |
|---|---|---|
| 3,687,808 A | 8/1972 | Merigan et al. |
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,469,863 A | 9/1984 | Ts'o et al. |
| 4,476,301 A | 10/1984 | Imbach et al. |
| 4,535,060 A | 8/1985 | Comai |
| 4,581,847 A | 4/1986 | Hibberd et al. |
| 4,666,828 A | 5/1987 | Gusella |
| 4,683,202 A | 7/1987 | Mullis |
| 4,761,373 A | 8/1988 | Anderson et al. |
| 4,769,061 A | 9/1988 | Comai |
| 4,801,531 A | 1/1989 | Frossard |
| 4,810,648 A | 3/1989 | Stalker |
| 4,879,219 A | 11/1989 | Wands et al. |
| 4,940,835 A | 7/1990 | Shah et al. |
| 4,971,908 A | 11/1990 | Kishore et al. |
| 5,004,863 A | 4/1991 | Umbeck |
| 5,011,771 A | 4/1991 | Bellet et al. |
| 5,013,659 A | 5/1991 | Bedbrook et al. |
| 5,015,580 A | 5/1991 | Christou et al. |
| 5,023,243 A | 6/1991 | Tullis |
| 5,034,506 A | 7/1991 | Summerton et al. |
| 5,094,945 A | 3/1992 | Comai |

(Continued)

FOREIGN PATENT DOCUMENTS

| | | |
|---|---|---|
| AU | 2008258254 B2 | 7/2014 |
| AU | 20 14262189 B2 | 11/2014 |

(Continued)

OTHER PUBLICATIONS

Wang, C. J., and Z. Q. Liu. "Foliar uptake of pesticides—present status and future challenge." Pesticide Biochemistry and Physiology 87. 1 (2007): 1-8. (Year: 2007).*

(Continued)

*Primary Examiner* — Weihua Fan

(74) *Attorney, Agent, or Firm* — Arnold & Porter Kaye Scholer

(57) ABSTRACT

Novel compositions for use to enhance weed control. Specifically, the present invention provides for methods and compositions that modulate protoporphyrinogen IX oxidase in weed species. The present invention also provides for combinations of compositions and methods that enhance weed control.

19 Claims, 3 Drawing Sheets

Specification includes a Sequence Listing.

(56) References Cited

U.S. PATENT DOCUMENTS

| | | |
|---|---|---|
| 5,141,870 A | 8/1992 | Bedbrook et al. |
| 5,145,783 A | 9/1992 | Kishore et al. |
| 5,159,135 A | 10/1992 | Umbeck |
| 5,166,315 A | 11/1992 | Summerton et al. |
| 5,177,196 A | 1/1993 | Meyer, Jr. et al. |
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |
| 5,276,019 A | 1/1994 | Cohen et al. |
| 5,281,521 A | 1/1994 | Trojanowski et al. |
| 5,286,634 A | 2/1994 | Stadler et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,384,253 A | 1/1995 | Krzyzek et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,459,127 A | 10/1995 | Felgner et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Haberlein et al. |
| 5,558,071 A | 9/1996 | Ward et al. |
| 5,561,225 A | 10/1996 | Maddry et al. |
| 5,561,236 A | 10/1996 | Leemans et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,597,717 A | 1/1997 | Guerineau et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,719,046 A | 2/1998 | Guerineau et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A * | 11/1999 | Sandbrink ............ A01N 25/00 424/405 |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |
| 6,232,526 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Ålkens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,479,291 B2 | 11/2002 | Kumagai et al. |
| 6,506,559 B1 | 1/2003 | Fire et al. |

(56) References Cited

U.S. PATENT DOCUMENTS

| | | |
|---|---|---|
| 6,506,599 B1 | 1/2003 | Yoon |
| 6,642,435 B1 | 11/2003 | Rafalski et al. |
| 6,644,341 B1 | 11/2003 | Chemo et al. |
| 6,645,914 B1 | 11/2003 | Woznica et al. |
| 6,768,044 B1 | 7/2004 | Boudec et al. |
| 6,992,237 B1 | 1/2006 | Habben et al. |
| 7,022,896 B1 | 4/2006 | Weeks et al. |
| 7,026,528 B2 | 4/2006 | Cheng et al. |
| RE39,247 E | 8/2006 | Barry et al. |
| 7,105,724 B2 | 9/2006 | Weeks et al. |
| 7,119,256 B2 | 10/2006 | Shimizu et al. |
| 7,138,564 B2 | 11/2006 | Tian et al. |
| 7,297,541 B2 | 11/2007 | Moshiri et al. |
| 7,304,209 B2 | 12/2007 | Zink et al. |
| 7,312,379 B2 | 12/2007 | Andrews et al. |
| 7,323,310 B2 | 1/2008 | Peters et al. |
| 7,371,927 B2 | 5/2008 | Yao et al. |
| 7,392,379 B2 | 6/2008 | Le Pennec et al. |
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,884,262 B2 | 2/2011 | Clemente et al. |
| 7,910,805 B2 | 3/2011 | Duck et al. |
| 7,935,869 B2 | 5/2011 | Pallett et al. |
| 7,943,819 B2 | 5/2011 | Baum et al. |
| 7,973,218 B2 | 7/2011 | McCutchen et al. |
| 8,090,164 B2 | 1/2012 | Bullitt et al. |
| 8,143,480 B2 | 3/2012 | Axtell et al. |
| 8,226,938 B1 | 7/2012 | Meikle et al. |
| 8,548,778 B1 | 10/2013 | Hart et al. |
| 8,554,490 B2 | 10/2013 | Tang et al. |
| 9,121,022 B2 | 9/2015 | Sammons et al. |
| 9,422,557 B2 | 8/2016 | Ader |
| 9,445,603 B2 | 9/2016 | Baum et al. |
| 9,777,288 B2 | 10/2017 | Beattie et al. |
| 9,850,496 B2 | 12/2017 | Beattie et al. |
| 9,856,495 B2 | 10/2018 | Beattie et al. |
| 2001/0006797 A1 | 7/2001 | Kumagai et al. |
| 2001/0042257 A1 | 11/2001 | Connor-Ward et al. |
| 2002/0069430 A1 | 6/2002 | Kiaska et al. |
| 2002/0106653 A1 | 8/2002 | Kurane et al. |
| 2002/0114784 A1 | 8/2002 | Li et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2003/0221211 A1 | 11/2003 | Rottmann et al. |
| 2004/0029275 A1 | 2/2004 | Brown et al. |
| 2004/0053289 A1 | 3/2004 | Allen et al. |
| 2004/0055041 A1 | 3/2004 | Labate et al. |
| 2004/0072692 A1 | 4/2004 | Hoffman et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cai et al. |
| 2004/0250310 A1 | 12/2004 | Shukla et al. |
| 2005/0005319 A1 | 1/2005 | della-Cioppa et al. |
| 2005/0044591 A1* | 2/2005 | Yao .................. C12N 9/90 800/287 |
| 2005/0215435 A1 | 9/2005 | Menges et al. |
| 2005/0223425 A1 | 10/2005 | Clinton et al. |
| 2005/0246784 A1 | 11/2005 | Plesch et al. |
| 2005/0250647 A1 | 11/2005 | Hills et al. |
| 2005/0289664 A1 | 12/2005 | Moshiri et al. |
| 2006/0009358 A1 | 1/2006 | Kibler et al. |
| 2006/0021087 A1 | 1/2006 | Baum et al. |
| 2006/0040826 A1 | 2/2006 | Eaton et al. |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffman et al. |
| 2006/0223709 A1 | 10/2006 | Helmke et al. |
| 2006/0247197 A1 | 11/2006 | Van De Craen et al. |
| 2006/0272049 A1 | 11/2006 | Waterhouse et al. |
| 2006/0276339 A1 | 12/2006 | Windsor et al. |
| 2007/0011775 A1 | 1/2007 | Allen et al. |
| 2007/0021360 A1 | 1/2007 | Nyce et al. |
| 2007/0050863 A1* | 3/2007 | Tranel .................. C12N 9/001 800/278 |
| 2007/0124836 A1 | 5/2007 | Baum et al. |
| 2007/0199095 A1 | 8/2007 | Allen et al. |
| 2007/0250947 A1 | 10/2007 | Boukharov et al. |
| 2007/0259785 A1 | 11/2007 | Heck et al. |
| 2007/0269815 A1 | 11/2007 | Rivory et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0113351 A1 | 5/2008 | Naito et al. |
| 2008/0155716 A1 | 6/2008 | Sonnewald et al. |
| 2008/0214443 A1 | 9/2008 | Baum et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0075921 A1 | 3/2009 | Ikegawa et al. |
| 2009/0094717 A1 | 4/2009 | Troukhan et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0144848 A1 | 6/2009 | Kovalic et al. |
| 2009/0165153 A1 | 6/2009 | Wang et al. |
| 2009/0165166 A1 | 6/2009 | Feng et al. |
| 2009/0172838 A1 | 7/2009 | Axtell et al. |
| 2009/0188005 A1 | 7/2009 | Boukharov et al. |
| 2009/0205079 A1 | 8/2009 | Kumar et al. |
| 2009/0215628 A1 | 8/2009 | Witschel et al. |
| 2009/0285784 A1 | 11/2009 | Raemaekers et al. |
| 2009/0293148 A1 | 11/2009 | Ren et al. |
| 2009/0298787 A1 | 12/2009 | Raemaekers et al. |
| 2009/0306189 A1 | 12/2009 | Raemaekers et al. |
| 2009/0307803 A1 | 12/2009 | Baum et al. |
| 2010/0005551 A1 | 1/2010 | Roberts et al. |
| 2010/0048670 A1 | 2/2010 | Biard et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0192237 A1 | 7/2010 | Ren et al. |
| 2010/0247578 A1 | 9/2010 | Salama |
| 2010/0248373 A1 | 9/2010 | Baba et al. |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 | 2/2011 | Eudes et al. |
| 2011/0041400 A1 | 2/2011 | Trias Vila et al. |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |

(56) References Cited

U.S. PATENT DOCUMENTS

| | | | |
|---|---|---|---|
| 2011/0152353 A1 | 6/2011 | Koizumi et al. |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Poree et al. |
| 2011/0201501 A1 | 8/2011 | Song et al. |
| 2011/0203013 A1 | 8/2011 | Peterson et al. |
| 2011/0296555 A1 | 12/2011 | Ivashuta et al. |
| 2011/0296556 A1 | 12/2011 | Sammons et al. |
| 2012/0036594 A1 | 2/2012 | Cardoza et al. |
| 2012/0107355 A1 | 5/2012 | Harris et al. |
| 2012/0108497 A1 | 5/2012 | Paldi et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0157512 A1 | 6/2012 | Ben-Chanoch et al. |
| 2012/0164205 A1 | 6/2012 | Baum et al. |
| 2012/0174262 A1 | 7/2012 | Azhakanandam et al. |
| 2012/0185967 A1 | 7/2012 | Sela et al. |
| 2012/0198586 A1 | 8/2012 | Narva et al. |
| 2012/0230565 A1 | 9/2012 | Steinberg et al. |
| 2012/0258646 A1 | 10/2012 | Sela et al. |
| 2013/0003213 A1 | 1/2013 | Kabelac et al. |
| 2013/0041004 A1 | 2/2013 | Drager et al. |
| 2013/0047297 A1 | 2/2013 | Sammons et al. |
| 2013/0047298 A1 | 2/2013 | Tang |
| 2013/0060133 A1 | 3/2013 | Kassab et al. |
| 2013/0067618 A1 | 3/2013 | Ader et al. |
| 2013/0084243 A1 | 4/2013 | Goetsch et al. |
| 2013/0096073 A1 | 4/2013 | Sidelman |
| 2013/0097726 A1 | 4/2013 | Ader et al. |
| 2013/0212739 A1 | 8/2013 | Giritch et al. |
| 2013/0226003 A1 | 8/2013 | Edic et al. |
| 2013/0247247 A1 | 9/2013 | Ader et al. |
| 2013/0254940 A1 | 9/2013 | Ader et al. |
| 2013/0254941 A1 | 9/2013 | Ader et al. |
| 2013/0288895 A1 | 10/2013 | Ader et al. |
| 2013/0318657 A1 | 11/2013 | Avniel et al. |
| 2013/0318658 A1 | 11/2013 | Ader et al. |
| 2013/0324842 A1 | 12/2013 | Mittal et al. |
| 2013/0326731 A1 | 12/2013 | Ader et al. |
| 2014/0018241 A1 | 1/2014 | Sammons et al. |
| 2014/0057789 A1 | 2/2014 | Sammons et al. |
| 2014/0109258 A1 | 4/2014 | Van De Craen et al. |
| 2014/0230090 A1 | 8/2014 | Avniel et al. |
| 2014/0274712 A1 | 9/2014 | Finnessy et al. |
| 2014/0275208 A1 | 9/2014 | Hu et al. |
| 2014/0296503 A1 | 10/2014 | Avniel et al. |
| 2015/0096079 A1 | 4/2015 | Avniel et al. |
| 2015/0143580 A1 | 5/2015 | Beattie et al. |
| 2015/0159156 A1 | 6/2015 | Inberg et al. |
| 2015/0203867 A1 | 7/2015 | Beattie et al. |
| 2015/0240258 A1 | 8/2015 | Beattie et al. |
| 2016/0015035 A1 | 1/2016 | Tao |
| 2016/0029644 A1 | 2/2016 | Tao |

FOREIGN PATENT DOCUMENTS

| | | | |
|---|---|---|---|
| CN | 101279950 A | 10/2008 |
| CN | 101279951 A | 10/2008 |
| CN | 101892247 A | 11/2010 |
| CN | 101914540 A | 12/2010 |
| CN | 102154364 A | 8/2011 |
| CN | 102481311 A | 5/2012 |
| CN | 102822350 A | 12/2012 |
| CN | 102906263 A | 1/2013 |
| DE | 288618 A5 | 4/1991 |
| DE | 10000600 A1 | 7/2001 |
| DE | 10116399 A1 | 10/2002 |
| DE | 10256353 A1 | 6/2003 |
| DE | 10256354 A1 | 6/2003 |
| DE | 10256367 A1 | 6/2003 |
| DE | 10204951 A1 | 8/2003 |
| DE | 10234875 A1 | 2/2004 |
| DE | 10234876 A1 | 2/2004 |
| DE | 102004054666 A1 | 5/2006 |
| DE | 102005014638 A1 | 10/2006 |
| DE | 102005014906 A1 | 10/2006 |
| DE | 102007012168 A1 | 9/2008 |
| DE | 102010042866 A1 | 5/2011 |
| EP | 0 804 600 A1 | 11/1997 |
| EP | 1 155 615 A1 | 11/2001 |
| EP | 1 157 991 A2 | 11/2001 |
| EP | 1 238 586 A1 | 9/2002 |
| EP | 1 416 049 A1 | 5/2004 |
| EP | 1 496 123 A1 | 1/2005 |
| EP | 1 889 902 A1 | 2/2008 |
| EP | 2 147 919 A1 | 1/2010 |
| EP | 2 160 098 B1 | 11/2010 |
| EP | 2 530 159 A1 | 3/2011 |
| EP | 2 305 813 A2 | 4/2011 |
| EP | 2 473 024 A2 | 7/2012 |
| EP | 2 545 182 A1 | 1/2013 |
| JP | 2001253874 A | 9/2001 |
| JP | 2002080454 A | 3/2002 |
| JP | 2002138075 A | 5/2002 |
| JP | 2002145707 A | 5/2002 |
| JP | 2002220389 A | 8/2002 |
| JP | 2003064059 A | 3/2003 |
| JP | 2003096059 A | 4/2003 |
| JP | 2004051628 A | 2/2004 |
| JP | 2004107228 A | 4/2004 |
| JP | 2005008583 A | 1/2005 |
| JP | 2005239675 A | 9/2005 |
| JP | 2005314407 A | 11/2005 |
| JP | 2006232824 A | 9/2006 |
| JP | 2006282552 A | 10/2006 |
| JP | 2007153847 A | 6/2007 |
| JP | 2007161701 A | 6/2007 |
| JP | 2007182404 A | 7/2007 |
| JP | 2008074840 A | 4/2008 |
| JP | 2008074841 A | 4/2008 |
| JP | 2008133207 A | 6/2008 |
| JP | 2008133218 A | 6/2008 |
| JP | 2008169121 A | 7/2008 |
| JP | 2009067739 A | 4/2009 |
| JP | 2009114128 A | 5/2009 |
| JP | 2009-508481 A | 6/2009 |
| JP | 2009126792 A | 6/2009 |
| JP | 2009137851 A | 6/2009 |
| JP | 2016-532440 A | 10/2015 |
| RU | 2 291 613 C1 | 1/2007 |
| RU | 2 337 529 C1 | 11/2008 |
| WO | WO 89/11789 A1 | 12/1989 |
| WO | WO 95/34659 A1 | 12/1995 |
| WO | WO 95/34668 A2 | 12/1995 |
| WO | WO 96/005721 A1 | 2/1996 |
| WO | WO 96/033270 A1 | 10/1996 |
| WO | WO 96/038567 A2 | 12/1996 |
| WO | WO 96/040964 A2 | 12/1996 |
| WO | WO 97/49816 A1 | 12/1997 |
| WO | WO 99/14348 A1 | 3/1999 |
| WO | WO 99/024585 A1 | 5/1999 |
| WO | WO 99/26467 A1 | 6/1999 |
| WO | WO 99/27116 A2 | 6/1999 |
| WO | WO 99/32619 A1 | 7/1999 |
| WO | WO 99/61631 A1 | 12/1999 |
| WO | WO 99/67367 A1 | 12/1999 |
| WO | WO 00/32757 A2 | 6/2000 |
| WO | WO 00/044914 A1 | 8/2000 |
| WO | WO 01/07601 A2 | 2/2001 |
| WO | WO 2001/085970 A2 | 11/2001 |
| WO | WO 02/14472 A2 | 2/2002 |
| WO | WO 02/066660 A2 | 8/2002 |
| WO | WO 03/000679 A2 | 1/2003 |
| WO | WO 03/004649 | 1/2003 |
| WO | WO 03/006422 A1 | 1/2003 |
| WO | WO 2003/004649 A1 | 1/2003 |
| WO | WO 03/012052 A2 | 2/2003 |

(56) References Cited

FOREIGN PATENT DOCUMENTS

| | | |
|---|---|---|
| WO | WO 03/013247 A1 | 2/2003 |
| WO | WO 03/016308 A1 | 2/2003 |
| WO | WO 03/020704 A1 | 3/2003 |
| WO | WO 03/022051 A1 | 3/2003 |
| WO | WO 03/022831 A1 | 3/2003 |
| WO | WO 03/022843 A1 | 3/2003 |
| WO | WO 03/029243 A2 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/064625 A2 | 8/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A2 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/007860 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |
| WO | WO 2005/107437 A2 | 11/2005 |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/132270 A1 | 12/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/038788 A2 | 4/2007 |
| WO | WO 2007/039454 A1 | 4/2007 |
| WO | WO 2007/050715 A2 | 5/2007 |
| WO | WO 2007/051462 A2 | 5/2007 |
| WO | WO 2007/070389 A2 | 6/2007 |
| WO | WO 2007/071900 A1 | 6/2007 |
| WO | WO 2007/074405 A2 | 7/2007 |
| WO | WO 2007/077201 A1 | 7/2007 |
| WO | WO 2007/077247 A1 | 7/2007 |
| WO | WO 2007/080126 A2 | 7/2007 |
| WO | WO 2007/080127 A2 | 7/2007 |
| WO | WO 2007/083193 A2 | 7/2007 |
| WO | WO 2007/096576 A1 | 8/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/029690 A1 | 3/2009 |
| WO | WO 2009/035150 A2 | 3/2009 |
| WO | WO 2009/037329 A2 | 3/2009 |
| WO | WO 2009/046384 A1 | 4/2009 |
| WO | WO 2009/060429 A2 | 5/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090401 A2 | 7/2009 |
| WO | WO 2009/090402 A2 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/144079 A1 | 12/2009 |
| WO | WO 2009/152995 A1 | 12/2009 |
| WO | WO 2009/153607 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |
| WO | WO 2010/049414 A1 | 5/2010 |
| WO | WO 2010/056519 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/093788 A2 | 8/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/130970 A1 | 11/2010 |
| WO | WO 2011/001434 A1 | 1/2011 |
| WO | WO 2011/003776 A1 | 1/2011 |
| WO | WO 2011/028836 A2 | 3/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |
| WO | WO 2011/075188 A1 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |

(56) References Cited

FOREIGN PATENT DOCUMENTS

| | | |
|---|---|---|
| WO | WO 2012/156342 A1 | 11/2012 |
| WO | WO 2012/164100 A2 | 12/2012 |
| WO | WO 2013/010691 A1 | 1/2013 |
| WO | WO 2013/025670 A1 | 2/2013 |
| WO | WO 2013/039990 A1 | 3/2013 |
| WO | WO 2013/040005 A1 | 3/2013 |
| WO | WO 2013/040021 A1 | 3/2013 |
| WO | WO 2013/040033 A1 | 3/2013 |
| WO | WO 2013/040049 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/022739 A2 | 2/2014 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A2 | 10/2014 |
| WO | WO 2015/010026 A2 | 1/2015 |
| WO | WO 2015/200539 A1 | 12/2015 |

OTHER PUBLICATIONS

Molina, Antonio, et al. "Inhibition of protoporphyrinogen oxidase expression in *Arabidopsis* causes a lesion-mimic phenotype that induces systemic acquired resistance." The Plant Journal 17.6 (1999): 667-678. (Year: 1999).*
Agricultural Chemical Usage 2006 Vegetables Summary, Agricultural Statistics Board, NASS, USDA, pp. 1-372 (2007).
Al-Kaff et al., "Plants rendered herbicide-susceptible by cauliflower mosaic virus-elicited suppression of a 35S promoter-regulated transgene," *Nature Biotechnology*, 18:995-999 (2000).
Balibrea et al., "Extracellular Invertase is an Essential Component of Cytokinin-Mediated Delay of Senescence," *The Plant Cell*, 16(5):1276-1287 (2004).
Bart et al., "A novel system for gene silencing using siRNAs in rice leaf and stem-derived protoplasts," *Plant Methods*, 2(13):1-9 (2006).
Basu et al., "Weed genomics: new tools to understand weed biology," *Trends in Plant Science*, 9(8):391-398 (2004).
Busch et al., "RNAi for discovery of novel crop protection products," *Pflanzenschutz-Nachrichten Bayer*, 58(1):34-50 (2005).
Chabannes et al., "In situ analysis of lignins in transgenic tobacco reveals a differential impact of individual transformations on the spatial patterns of lignin deposition at the cellular and subcellular levels," *The Plant Journal*, 28(3):271-282 (2001).
Chen et al., "Transfection and Expression of Plasmid DNA in Plant Cells by an Arginine-Rich Intracellular Delivery Peptide without Protoplast Preparation," *FEBS Letters* 581, pp. 1891-1897 (2007).
Colliver et al., "Differential modification of flavonoid and isoflavonoid biosynthesis with an antisense chalcone synthase construct in transgenic *Lotus corniculatus*," *Plant Molecular Biology*, 35:509-522 (1997).
Communication pursuant to Article 94(3) EPC dated Jan. 14, 2016, in European Patent Application No. 12 832 415.9.
Communication pursuant to Article 94(3) EPC dated Mar. 18, 2016, in European Patent Application No. 12 832 160.1.
Communication pursuant to Article 94(3) EPC dated Mar. 24, 2016, in European Patent Application No. 12 831 684.1.
Communication pursuant to Article 94(3) EPC dated Mar. 4, 2016, in European Patent Application No. 12 830 932.5.
Communication pursuant to Article 94(3) EPC dated Mar. 9, 2016, in European Patent Application No. 12 831 166.9.
Communication pursuant to Article 94(3) EPC dated Oct. 23, 2015, in European Patent Application No. 12 831 945.6.
Concise Descriptions of Relevance filed by a third party on Nov. 29, 2012, in U.S. Appl. No. 13/042,856.

Dawson et al., "cDNA cloning of the complete genome of tobacco mosaic virus and production of infectious transcripts," *Proc. Natl. Acad. Sci. USA*, 83:1832-1836 (1986).
Extended European Search Report dated Jan. 20, 2016, in European Patent Application No. 13 794 339.5.
Feuillet et al., "Crop genome sequencing: lessons and rationales," *Trends Plant Sci.*, 16:77-88 (2011).
Final Office Action dated Apr. 7, 2016, in U.S. Appl. No. 13/619,980.
Final Office Action dated Dec. 17, 2015, in U.S. Appl. No. 14/335,135.
Final Office Action dated Feb. 17, 2016, in U.S. Appl. No. 13/612,929.
Final Office Action dated Feb. 4, 2016, in U.S. Appl. No. 13/612,936.
Final Office Action dated Jun. 30, 2016, in U.S. Appl. No. 13/901,326.
Final Office Action dated Mar. 2, 2016, in U.S. Appl. No. 13/612,995.
Final Office Action dated Mar. 21, 2016, in U.S. Appl. No. 13/612,925.
Final Office Action dated May 26, 2016, in U.S. Appl. No. 14/532,596.
Final Office Action dated Nov. 10, 2015, in U.S. Appl. No. 13/612,985.
Final Office Action dated Sep. 9, 2016, in U.S. Appl. No. 13/612,954.
Final Office Action dated Nov. 19, 2015, in U.S. Appl. No. 13/612,941.
Final Office Action dated Sep. 9, 2016, in U.S. Appl. No. 14/608,951.
Final Office Action dated Sep. 9, 2016, in U.S. Appl. No. 14/603,347.
Final Office Action dated Oct. 20, 2016, in U.S. Appl. No. 14/480,199.
Final Office Action dated Nov. 30, 2015, in U.S. Appl. No. 13/612,948.
Final Office Action dated Oct. 22, 2015, in U.S. Appl. No. 14/608,951.
First Office Action dated Aug. 31, 2015, in Chinese Patent Application No. 201280053985.3.
First Office Action dated Feb. 2, 2016, in Chinese Patent Application No. 201380039346.6.
First Office Action dated Jul. 7, 2015, in Chinese Patent Application No. 201280054820.8.
First Office Action dated Sep. 9, 2015, in Chinese Patent Application No. 201280055409.2.
Fraley et al., "Liposome-mediated delivery of tobacco mosaic virus RNA into tobacco protoplasts: A sensitive assay for monitoring liposome-protoplast interactions," *Proc Natl Acad Sci U S A.*, 79(6):1859-1863 (1982).
Fukunaga et al., "dsRNA with 5' overhangs v contributes to endogenous and antiviral RNA silencing pathways in plants," *The EMBO Journal*, 28(5):545-555 (2009).
First Office Action dated Mar. 12, 2015, in Chinese Patent Application No. 201280053984.9.
First Office Action dated Mar. 2, 2015, in Chinese Patent Application No. 201280054819.5.
Gan et al., "Inhibition of Leaf Senescence by Autoregulated Production of Cytokinin," *Science*, 270:1986-1988 (1995).
Gao et al., "Nonviral Methods for siRNA Delivery," *Molecular Pharmaceutics*, 6(3):651-658 (2008).
GenBank Accession No. CB377464, "CmaE1_37_J02_J3 Cowpea weevil larvae Lambda Zap Express Library *Callosobruchus maculatus* cDNA, mRNA sequence," (2007).
GenBank Accession No. EW765249, "ST020010B10C12 Normalized and subtracted western corn rootworm female head cDNA library *Diabrotica virgifera virgifera* cDNA clone STO20010B10C12 5-, mRNA sequence," (2007).
GenBank Accession No. EW771198, "ST020010B10C12 Normalized and subtracted western corn rootworm female head cDNA library *Diabrotica virgifera virgifera* cDNA clone STO20010B10C12 5-, mRNA sequence," (2007).
GenBank Accession No. GU120406, "Chrysomela tremulae ribosomal protein L7 (RpL7) mRNA, complete cds" (2009).
GenBank Accession No. HD315444, "Sequence 192160 from Patent EP2213738" (2010).
GenBank Accession No. Q4GXM3_BIPLU, "Ribosomal protein L7e" (2006).
GenBank Accession No. U87257.1, "Daucus carota 4-hydroxyphenylpyruvate dioxygenase mRNA, complete cds" (1997).
GenBank Accession No. XM_014456745.1, Predicted: Myotis lucifugus ribonucleoprotein, PTB-binding 2 (RAVER2), transcript variant X3, mRNA,: (2015).
GenBank Accession No. Y08611.1, "*P. sativum* mRNA for dihydropterin pyrophosphokinase/dihydropteroate synthase " (2006).
Gossamer Threads, Compendium of Herbicide Adjuvants: Organo-Silicone Surfactant, p. 1-4 (1998).

(56) References Cited

OTHER PUBLICATIONS

Gudkov, "Minireview: The L7/L12 ribosomal domain of the ribosome: structural and functional studies," *FEBS Letters*, 407:253-256 (1997).
Hajirezaei et al., "Impact of elevated cytosolic and apoplastic invertase activity on carbon metabolism during potato tuber development," *Journal of Experimental Botany*, 51:439-445 (2000).
Heffer et al., "Rapid isolation of gene homologs across taxa: Efficient identification and isolation of gene orthologs from non-model organism genomes, a technical report," *EvoDevo Journal*, 2(7):1-5 (2011).
Holtra et al., "Assessment of the Physiological Condition of *Salvinia natans* L. Exposed to Copper(II) Ions," *Environ. Protect. Eng.*, 41:147-158 (2015).
International Preliminary Report on Patentability dated Sep. 11, 2012, in International Application No. PCT/US2011/027528.
International Rice Genome Sequencing Project, The map-based sequence of the rice genome, *Nature*, 436(11):793-800 (2005).
International Search Report and Written Opinion dated May 26, 2016, in International Application No. PCT/US2016/014344.
International Search Report and Written Opinion dated Nov. 24, 2015, in International Application No. PCT/US2015/037522.
International Search Report and Written Opinion dated Nov. 27, 2015, in International Application No. PCT/US2015/037015.
Invitation to Pay Additional Fees dated Sep. 8, 2015, in International Application No. PCT/US2015/037015.
Invitation to Pay Additional Fees dated Sep. 9, 2015, in International Application No. PCT/US2015/037522.
Jin et al., "Posttranslational Elevation of Cell Wall Invertase Activity by Silencing its Inhibitor in Tomato Delays Leaf Senescence and Increases Seed Weight and Fruit Hexose Level," *The Plant Cell*, 21:2072-2089 (2009).
Jofre-Garfias et al., "*Agrobacterium*-mediated transformation of *Amaranthus hypochondriacus*: light- and tissue-specific expression of a pea chlorophyll a/b-binding protein promoter," *Plant Cell Reports*, 16:847-852 (1997).
Kaloumenos et al., "Identification of a Johnsongrass (*Sorghum halepense*) Biotype Resistant to ACCase-Inhibiting Herbicides in Northern Greece," *Weed Technol*, 23:470-476 (2009).
Kambiranda et al., "Relationship Between Acid Invertase Activity and Sugar Content in Grape Species," *Journal of Food Biochemistry*, 35:1646-1652 (2011).
Kim et al., "Optimization of Conditions for Transient Agrobacterium-Mediated Gene Expression Assays in Arabidopsis," *Plant Cell Reports*, 28:1159-1167 (2009) Herewith.
Kirkwood, "Herbicides and Plants," *Botanical Journal of Scotland*, 46(3):447-462 (1993).
Knudsen, "Promoter2.0: for the recognition of PolI promoter sequences," *Bioniformatics*, 15(5):356-361 (1999).
Lein et al., "Target-based discovery of novel herbicides," *Current Opinion in Plant Biology*, 7:219-225 (2004).
Liu et al., "Identification and Application of a Rice Senescence-Associated Promoter," *Plant Physiology*, 153:1239-1249 (2010).
Liu, "Influence of Sugars on the Foliar Uptake of Bentazone and Glyphosate," *New Zealand Plant Protection*, 55:159-162 (2002).
Migge et al., "Greenhouse-grown conditionally lethal tobacco plants obtained by expression of plastidic glutamine synthetase antisense RNA may contribute to biological safety," *Plant Science* 153:107-112 (2000).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Mora et al., "How Many Species Are There on Earth and in the Ocean?," *PLOS Biol.*, 9(8):e100127, p. 1-8 (2011).
Mount et al., "Gene and Metabolite Regulatory Network Analysis of Early Developing Fruit Tissues Highlights New Candidate Genes for the Control of Tomato Fruit Composition and Development," *Plant Physiology*, 149:1505-1528 (2009).

Non-Final Office Action dated May 22, 2015, in U.S. Appl. No. 13/612,985.
Non-Final Office Action dated Aug. 19, 2016, in U.S. Appl. No. 13/612,925.
Non-Final Office Action dated Aug. 19, 2016, in U.S. Appl. No. 13/612,929.
Non-Final Office Action dated Apr. 29, 2016, in U.S. Appl. No. 13/583,302.
Non-Final Office Action dated Aug. 10, 2016, in U.S. Appl. No. 13/612,995.
Non-Final Office Action dated Aug. 3, 2016, in U.S. Appl. No. 14/015,715.
Non-Final Office Action dated Aug. 5, 2016, in U.S. Appl. No. 14/015,785.
Non-Final Office Action dated Aug. 8, 2016, in U.S. Appl. No. 13/612,936.
Non-Final Office Action dated Dec. 17, 2015, in U.S. Appl. No. 14/532,596.
Non-Final Office Action dated Feb. 10, 2016, in U.S. Appl. No. 13/901,326.
Non-Final Office Action dated Feb. 23, 2016, in U.S. Appl. No. 14/603,347.
Non-Final Office Action dated Feb. 23, 2016, in U.S. Appl. No. 14/608,951.
Non-Final Office Action dated Sep. 6, 2016, in U.S. Appl. No. 14/335,135.
Non-Final Office Action dated Mar. 1, 2016, in U.S. Appl. No. 13/612,954.
Non-Final Office Action dated Oct. 3, 2016, in U.S. Appl. No. 14/403,491.
Non-Final Office Action dated Sep. 1, 2015, in U.S. Appl. No. 13/612,954.
Non-Final Office Action dated Sep. 11, 2015, in U.S. Appl. No. 13/612,925.
Non-Final Office Action dated Sep. 4, 2015, in U.S. Appl. No. 13/612,995.
Nookaraju et al., "Molecular approaches for enhancing sweetness in fruits and vegetables," *Scientia Horticulture*, 127:1-15 (2010).
Nord-Larsen et al., "Cloning, characterization and expression analysis of tonoplast intrinsic proteins and glutamine synthetase in ryegrass (*Lolium perenne* L.)," *Plant Cell Reports*, 28(10):1549-1562 (2009).
Notice of Allowance dated Apr. 11, 2016, in U.S. Appl. No. 13/612,985.
Notice of Allowance dated Apr. 19, 2016, in U.S. Appl. No. 13/612,941.
Notice of Allowance dated Apr. 20, 2016, in U.S. Appl. No. 13/612,948.
Notice of Allowance dated Feb. 23, 2015, in U.S. Appl. No. 13/042,856.
Notice of Allowance dated Jun. 2, 2015, in U.S. Appl. No. 13/042,856.
Notice of Allowance dated Oct. 5, 2015, in U.S. Appl. No. 13/583,302.
Office Action dated Apr. 13, 2016, in Chinese Patent Application No. 201280053985.3.
Office Action dated Jul. 18, 2016, in Indonesian Patent Application No. W00201203610.
Office Action dated Aug. 25, 2016, in Eurasian Patent Application No. 201201264.
Office Action dated Jun. 20, 2016, in Chinese Patent Application No. 201280054819.5.
Office Action dated Jun. 24, 2016, in Chinese Patent Application No. 201280053984.9.
Office Action dated Jul. 23, 2015, in Ukrainian Patent Application No. 201211548.
Office Action issued on Oct. 5, 2015, in Eurasian Patent Application No. 201201264/28.
Patent Examination Report No. 1 dated Feb. 8, 2016, in Australian Patent Application No. 2014262189.
Patent Examination Report No. 1 dated Jun. 17, 2016, in Australian Patent Application No. 2012308659.
Patent Examination Report No. 1 dated Jun. 17, 2016, in Australian Patent Application No. 2012308660.

(56) References Cited

OTHER PUBLICATIONS

Patent Examination Report No. 1 dated Nov. 11, 2013, in Australian Patent Application No. 2011224570.
Promoter Prediction for Seq ID No. 1702 from 13/612929/MK/, Promoter 2.0 Prediction Results, pp. 1-4 (2016).
Promoter Prediction for Seq ID No. 4 from 13/612995/MK/, Promoter 2.0 Prediction Results, pp. 1-3 (2016).
Promoter Prediction for Seq ID No. 7 from 13/612936/MK/, Promoter 2.0 Prediction Results, pp. 1-2 (2016).
Promoter Prediction for Seq ID No. 8 from 13/612,925/MK/, Promoter 2.0 Prediction Results, pp. 1-6 (2016).
Restriction Requirement dated Jul. 15, 2016, in U.S. Appl. No. 14/143,748.
Restriction Requirement dated Jul. 18, 2016, in U.S. Appl. No. 14/143,836.
Restriction Requirement dated Oct. 13, 2016, in U.S. Appl. No. 14/206,707.
Restriction Requirement dated Oct. 28, 2015, in U.S. Appl. No. 14/603,347.
Restriction Requirement dated Sep. 2, 2015, in U.S. Appl. No. 14/532,596.
Restriction Requirement dated Feb. 12, 2015, in U.S. Appl. No. 13/612,985.
Roberts, "Fast-track applications: The potential for direct delivery of proteins and nucleic acids to plant cells for the discovery of gene function," *Plant Methods*, 1(12):1-3 (2005).
Robson et al., "Leaf senescence is delayed in maize expressing the Agrobacterium IPT gene under the control of a novel maize senescence-enhanced promoter," *Plant Biotechnology Journal*, 2:101-112 (2004).
Roitsch et al., "Extracellular invertase: key metabolic enzyme and PR protein," *Journal of Experimental Botany*, 54(382):513-524 (2003).
Roitsch et al., "Function and regulation of plant invertases: sweet sensations," *Trades in Plant Science*, 9(12):606-613 (2004).
Ruan et al., "Suppression of Sucrose Synthase Gene Expression Represses Cotton Fiber Cell Initiation, Elongation, and Seed Development," *The Plant Cell*, 15:952-964 (2003).
Salanenka et al., "Seedcoat Permeability: Uptake and Post-germination Transport of Applied Model Tracer Compounds," *HortScience*, 46(4):622-626 (2011).
Scott et al., "Botanical Insecticides for Controlling Agricultural Pests: Piperamides and the Colorado Potato Beetle *Leptinotarsa decemlineata* Say (Coleoptera: Chrysomelidae), *Archives of Insect Biochemistry and Physiology*, 54:212-225 (2003).
Second Office Action dated Feb. 25, 2016, in Chinese Patent Application No. 201280054179.8.
Second Office Action dated Mar. 4, 2016, in Chinese Patent Application No. 201280054820.8.
Shintani et al., "Antisense Expression and Overexpression of Biotin Carboxylase in Tobacco Leaves," *Plant Physiol.*, 114:881-886, (1997).
Showalter, "Structure and Function of Plant Cell Wall Proteins," *The Plant Cell*, 5:9-23 (1993).
Song et al., "Herbicide," *New Heterocyclic Pesticide*, Chemical Industry Press, 354-356 (2011).
Stevens, "Organosilicone Surfactants as Adjuvants for Agrochemicals," *Journal of Pesticide Science*, 38:103-122 (1993).
Tang et al., "Efficient delivery of small interfering RNA to plant cells by a nanosecond pulsed laser-induced stress wave for post-transcriptional gene silencing," *Plant Science*, 171:375-381 (2006).
Tenllado et al., "Double-Stranded RNA-Mediated Interference with Plant Virus Infection," *Journal of Virology*, 75(24):12288-12297 (2001).
Thomas et al., "Size constraints for targeting post-transcriptional gene silencing and for RNA-directed methylation in *Nicotiana benthamiana* using a potato virus X vector," *The Plant Journal*, 25(4):417-425 (2001).
Tomlinson et al., "Evidence that the hexose-to-sucrose ratio does not control the switch to storage product accumulation in oilseeds: analysis of tobacco seed development and effects of overexpressing apoplastic invertase," *Journal of Experimental Botany*, 55(406):2291-2303 (2004).
Wang et al., "Foliar uptake of pesticides—Present status and future challenge," ScienceDirect, 87:1-8 (2007).
Widholm et al., "Glyphosate selection of gene amplification in suspension cultures of 3 plant species," *Phyisologia Plantarum*, 112:540-545 (2001).
Wiesman et al., "Novel cationic vesicle platform derived from vernonia oil for efficient delivery of DNA through plant cuticle membranes," *Journal of Biotechnology*, 130:85-94 (2007).
Written Opinion dated Apr. 7, 2016, in Singapore Patent Application No. 201206152-9.
Zhang et al., "Chapter 10: New Characteristics of Pesticide Research & Development" *New Progress of the world agriculture chemicals*, p. 209 (2010).
Agrios, Plant Pathology (Second Edition), 2:466-470 (1978).
Alarcón-Reverte et al., "Resistance to ACCase-inhibiting herbicides in the weed *Lolium multiflorum*," Comm. Appl. Biol. Sci., 73(4):899-902 (2008).
Amarzguioui et al., "An algorithm for selection of functional siRNA sequences," Biochemical and Biophysical Research Communications, 316:1050-1058 (2004).
Ambrus et al., "The Diverse Roles of RNA Helicases in RNAi," Cell Cycle, 8(21):3500-3505 (2009).
An et al., "Transient RNAi Induction against Endogenous Genes in *Arabidopsis* Protoplasts Using in Vitro-Prepared Double-Stranded RNA," Biosci Biotechnol Biochem, 69(2):415-418 (2005).
Andersson et al., "A novel selection system for potato transformation using a mutated AHAS gene," Plant Cell Reports, 22(4):261-267 (2003).
Anonymous, "Resistant Weeds Spur Research Into New Technologies," Grains Research & Development Corporation, 2013.
Anonymous, "A handbook for high-level expression and purification of 6xHis-tagged proteins," The QiaExpressionist, (2003).
Anonymous, "Agronomy Facts 37: Adjuvants for enhancing herbicide performance," n.p. 1-8, (Jan. 26, 2000), Web, (Jan. 21, 2014).
Anonymous, "Devgen, The mini-Monsanto," KBC Securities (2006).
Anonymous, "Do Monsanto have the next big thing?," Austalian Herbicide Resistance Initiative (AHRI), (Apr. 23, 2013) Web. (Jan. 19, 2015).
Aoki et al., "In Vivo Transfer Efficiency of Antisense Oligonucleotides into the Myocardium Using HVJ—Liposome Method," Biochem Biophys Res Commun, 231:540-545 (1997).
Arpaia et al., "Production of transgenic eggplant (*Solanum melongena* L.) resistant to Colorado Potato Beetle (*Leptinotarsa decemlineata* Say)," (1997) Theor. Appl. Genet., 95:329-334 (1997).
Artymovich, "Using RNA interference to increase crop yield and decrease pest damage," MMG 445 Basic Biotech., 5(1):7-12 (2009).
Ascencio-Ibanez et al., "DNA abrasion onto plants is an effective method for geminivirus infection and virus-induced gene silencing," Journal of Virological Methods, 142:198-203 (2007).
Axtell et al., "A Two-Hit Trigger for siRNA Biogenesis in Plants," Cell, 127:565-577 (2006).
Bachman et al., "Characterization of the spectrum of insecticidal activity of a double-stranded RNA with targeted activity against Western Corn Rootworm (*Diabrotica virgifera virgifera* LeConte)," Transgenic Res., pp. 1-16 (2013).
Baerson et al., "Glyphosate-Resistant Goosegrass. Identification of a Mutation in the Target Enzyme 5-Enolpyruvylshikimate-3-Phosphate Synthase," Plant Physiol., 129(3):1265-1275 (2002).
Bai et al., "Naturally Occurring Broad-Spectrum Powdery Mildew Resistance in a Central American Tomato Accession Is Caused by Loss of Mlo Function," MPMI, 21(1):30-39 (2008).
Bannerjee et al., "Efficient production of transgenic potato (*S. tuberosum* L. ssp. *andigena*) plants via Agrobacterium tumefaciens-mediated transformation," Plant Sci., 170:732 738 (2006).
Baulcombe, "RNA silencing and heritable epigenetic effects in tomato and *Arabidopsis*," Abstract 13th Annual Fall Symposium, Plant Genomes to Phenomes, Donald Danforth Plant Science Center, 28-30 (2011).

(56) References Cited

OTHER PUBLICATIONS

Bayer et al., "Programmable ligand-controlled riboregulators of eukaryotic gene expression," Nature Biotechnol., 23(3):337-343 (2005).
Beal, et al., "Second Structural Motif for Recognition of DNA by Oligonucleotide-Directed Triple-Helix Formation," Science, 251:1360-1363 (1992).
Becker et al., "Fertile transgenic wheat from microprojectile bombardment of scutellar tissue," The Plant Journal, 5(2):299-307 (1994).
Bhargava et al., "Long double-stranded RNA-mediated RNA interference as a tool to achieve site-specific silencing of hypothalamic neuropeptides," Brain Research Protocols, 13:115-125 (2004).
Boletta et al., "High Efficient Non-Viral Gene Delivery to the Rat Kidney by Novel Polycationic Vectors," J. Am Soc. Nephroi., 7:1728 (1996).
Bolognesi et al., "Characterizing the Mechanism of Action of Double-Stranded RNA Activity against Western Corn Rootworm(*Diabrotica virgifera virgifera* LeConte)," PLoS ONE 7(10):e47534 (2012).
Bolter et al., "A chloroplastic inner envelope membrane protease is essential for plant development," FEBS Letters, 580:789-794 (2006).
Bourgeois et al., "Field and producer survey of ACCase resistant wild oat in Manitoba," Canadian Journal of Plant Science, 709-715 (1997).
Breaker et al., "A DNA enzyme with Mg2+-dependent RNA phosphoesterase activity," Chemistry and Biology, 2:655-660 (1995).
Brodersen et al., "The diversity of RNA silencing pathways in plants," Trends in Genetics, 22(5):268-280 (2006).
Brugière et al., "Glutamine Synthetase in the Phloem Plays a Major Role in Controlling Proline Production," The Plant Cell, 11:1995-2011 (1999).
Burgos et al., "Review: Confirmation of Resistance to Herbicides and Evaluation of Resistance Levels," Weed Science, 61 (1):4-20 (2013).
Busi et al., "Gene flow increases the initial frequency of herbicide resistance alleles in unselectedpopulations," Agriculture, Ecosystems and Environments, Elsevier, Amsterdam, NL, 142(3):403-409 (2011).
Butler et al., "Priming and re-drying improve the survival of mature seeds of Digitalis purpurea during storage," Annals of Botany, 103:1261-1270 (2009).
Bytebier et al., "T-DNA organization in tumor cultures and transgenic plants of the monocotyledon *Asparagus officinalis*," Proc. Natl. Acad. Sci. U.S.A., 84:5345-5349 (1987).
Campbell et al., "Gene-knockdown in the honey bee mite *Varroa destructor* by a non-invasive approach: studies on a glutathione S-transferase," Parasites & Vectors, 3(1):73, pp. 1-10 (2010).
Chabbouh et al., "Cucumber mosaic virus in artichoke," FAO Plant Protection Bulletin, 38:52-53 (1990).
Chakravarty et al., "Genetic Transformation in Potato: Approaches and Strategies," Amer J Potato Res, 84:301 311 (2007).
Chang et al., "Cellular Internalization of Fluorescent Proteins via Arginine-rich Intracellular Delivery Peptide in Plant Cells," Plant Cell Physiol., 46(3):482-488 (2005).
Chee et al., "Transformation of Soybean (*Glycine max*) by Infecting Germinating Seeds with Agrobacterium tumefaciens," Plant Physiol., 91:1212-1218 (1989).
Chen et al., "In Vivo Analysis of the Role of atTic20 in Protein Import into Chloroplasts," The Plant Cell, 14:641-654 (2002).
Cheng et al., "Production of fertile transgenic peanut (*Arachis hypogaea* L.) plants using Agrobacterium tumefaciens," Plant Cell Reports, 15:653-657 (1996).
Chi et al., "The Function of RH22, a DEAD RNA Helicase, in the Biogenesis of the 50S Ribosomal Subunits of *Arabidopsis* Chloroplasts," Plant Physiology, 158:693-707 (2012).
Christiaens et al., "The challenge of RNAi-mediated control of hemipterans," Current Opinion in Insect Science, 6:15-21 (2014).
Chupp et al., "Chapter 8: White Rust," Vegetable Diseases and Their Control, The Ronald Press Company, New York, pp. 267-269 (1960).
Clough et al., "Floral dip: a simplified method for Agrobacterium-mediated transformation of *Arabidopsis thaliana*," The Plant Journal, 16(6):735-743 (1998).
CN101914540 Patent Diclosure, "Introduction of RNA into plant by interference," (2010).
Colbourne et al., "The Ecoresponsive Genome of Daphnia pulex," Science, 331(6017):555-561 (2011).
Communication pursuant to Article 94(3) EPC dated Jun. 26, 2015, in European Patent Application No. 11 753 916.3.
Constan et al., "An outer envelope membrane component of the plastid protein import apparatus plays an essential role in *Arabidopsis*," The Plant Journal, 38:93-106 (2004).
Cooney et al., "Site-Specific Oligonucleotide Binding Represses Transcription of the Human c-myc Gene in Vitro," Science ,241:456-459 (1988).
COST Action FA0806 progress report "Plant virus control employing RNA-based vaccines: A novel non-transgenic strategy" (2010).
Coticchia et al., "Calmodulin modulates Akt activity in human breast cancer cell lines," Breast Cancer Res. Treat, 115:545-560 (2009).
Dalakouras et al., "Induction of Silencing in Plants by High-Pressure Spraying of In vitro-Synthesized Small RNAs," Frontiers in Plant Science, 7(1327):1-5 (2016).
Dalmay et al., "An RNA-Depenedent RNA Polymerase Gene in *Arabidopsis* Is Required for Posttranscriptional Gene Silencing Mediated by a Transgene but Not by a Virus," Cell, 101:543-553 (2000).
Davidson et al., "Engineering regulatory RNAs," Trends in Biotechnology, 23(3):109-112 (2005).
De Block, et al. "Engineering herbicide resistance in plants by expression of a detoxifying enzyme," EMBO J. 6(9):2513-2519 (1987).
De Framond, "MINI-Ti: A New Vector Strategy for Plant Genetic Engineering," Nature Biotechnology, 1:262-269 (1983).
Della-Cioppa et al., "Import of a precursor protein into chloroplasts is inhibited by the herbicide glyphosate," The EMBO Journal, 7(5):1299-1305 (1988).
Desai et al., "Reduction in deformed wing virus infection in larval and adult honey bees (*Apis mellifera* L.) by double-stranded RNA ingestion," Insect Molecular Biology, 21(4):446-455 (2012).
Di Stilio et al., "Virus-Induced Gene Silencing as a Tool for Comparative Functional Studies in Thalictrum," PLoS One, 5(8):e12064 (2010).
Diallo et al., "Long Endogenous dsRNAs Can Induce Complete Gene Silencing in Mammalian Cells and Primary Cultures," Oligonucleotides, 13:381-392 (2003).
Dietemann et al., "Varroa destructor: research avenues towards sustainable control," Journal of Apicultural Research, 51(1):125-132 (2012).
Du et al., "A systematic analysis of the silencing effects of an active siRNA at all single-nucleotide mismatched target sites," Nucleic Acids Research, 33(5):1671-1677 (2005).
Dunoyer et al., "Small RNA Duplexes Function as Mobile Silencing Signals Between Plant Cells," Science, 328:912-916 (2010).
Eamens et al., "RNA Silencing in Plants: Yesterday, Today, and Tomorrow," Plant Physiology, 147(2):456-468 (2008).
Ellington et al., "In vitro selection of RNA molecules that bind specific ligands," Nature, 346:818-822 (1990).
Emery et al., "Radial Patterning of *Arabidopsis* Shoots by Class III HD-ZIP and KANADI Genes," Current Biology, 13:1768-1774 (2003).
Eudes et al., "Cell-penetrating peptides," Plant Signaling & Behavior, 3(8):549-5550 (2008).
European Cooperation in the field of Scientific and Technical Research—Memorandum of Understanding for COST Action FA0806 (2008).
EP Search Report dated Sep. 7, 2017, in European Patent Application No. 17152830.0.
Extended European Search Report dated Feb. 2, 2015, in European Patent Application No. 12 830 932.5.

(56) References Cited

OTHER PUBLICATIONS

Extended European Search Report dated Feb. 27, 2015, in European Patent Application No. 12 832 160.1.
Extended European Search Report dated Feb. 3, 2015, in European Patent Application No. 12 831 945.6.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Jun. 29, 2015, in European Patent Application No. 12 831 494.5.
Extended European Search Report dated Mar. 17, 2015, in European Patent Application No. 12 831 684.1.
Extended European Search Report dated Mar. 3, 2015, in European Patent Application No. 12 831 166.9.
Extended European Search Report dated Nov. 7, 2017, in European Patent Application No. 15811092.4.
Extended European Search Report dated Nov. 8, 2017, in European Patent Application No. 15737282.2.
Extended European Search Report dated Oct. 8, 2013, in European Patent Application No. 11753916.3.
Extended European Search Report dated Sep. 29, 2016, in European Patent Application No. 14778840.0.
Farooq et al., "Rice seed priming," IPRN, 30(2):45-48 (2005).
Fassler, BLAST Glossary, National Center for Biotechnology Information (2011).
Fernandez et al., "Uptake of Hydrophilic Solutes Through Plant Leaves: Current State of Knowledge and Perspectives of Foliar Fertilization," Critical Reviews in Plant Sciences, 28:36-38 (2009).
Final Office Action dated Nov. 10, 2016, in U.S. Appl. No. 13/583,302.
Final Office Action dated Nov. 7, 2013, in U.S. Appl. No. 13/042,856.
Fire et al., "Potent and specific genetic interference by double-stranded RNA in Caenorhabditis elegans," Nature, 391:806-811 (1998).
First Examination Report dated Apr. 23, 2013, in New Zealand Patent Application No. 601784.
First Examination Report dated Jul. 28, 2014, in New Zealand Patent Application No. 627060.
First Office Action dated May 27, 2015, in Chinese Patent Application No. 201280054179.8.
Fukuhara et al., "Enigmatic Double-Stranded RNA in *japonica* Rice," Plant Molecular Biology, 21:1121-1130 (1993).
Fukuhara et al., "The Unusual Structure of a Novel RNA Replicon in Rice," The Journal of Biological Chemistry, 270(30):18147-18149 (1995).
Fukuhara et al., "The wide distribution of endornaviruses, large double-stranded RNA replicons with plasmid-like properties," Archives of Virology, 151:995-1002 (2006).
Further Examination Report dated May 16, 2014, in New Zealand Patent Application No. 601784.
Gaines et al., "Gene amplification confers glyphosate resistance in Amaranthus palmeri," Proc. Natl. Acad. Sci. USA, 107(3):1029-1034 (2010).
Gan et al., "Bacterially expressed dsRNA protects maize against SCMV infection," Plant Cell Rep, 29(11):1261-1268 (2010).
Gao et al., "Down-regulation of acetolactate synthase compromises 01-1-mediated resistance to powdery mildew in tomato," BMC Plant Biology, 14 (2014).
Garbian et al., "Bidirectional Transfer of RNAi between Honey Bee and Varroa destructor: Varroa Gene Silencing Reduces Varroa Population," 8(12):1-9:e1003035 (2012).
Gaskin et al., "Novel organosillicone adjuvants to reduce agrochemical spray volumes on row crops," New Zealand Plant Protection, 53:350-354 (2000).
Ge et al., "Rapid vacuolar sequestration: the horseweed glyphosate resistance mechanism," Pest Management Sci., 66:345-348 (2010).
GenBank Accession No. AY545657.1 (2004).
GenBank Accession No. DY640489, "PU2_plate27_F03 PU2 Prunus persica cDNA similar to expressed mRNA inferred from Prunus persica hypothetical domain/motif containing IPR011005:Dihydropteroate synthase-like, MRNA sequence" (2006).
GenBank Accession No. EF143582 (2007).
GenBank Accession No. EU024568, "Amaranthus hypochondriacus acetolactate synthase (ALS) gene" (2007).
GenBank Accession No. FE348695, "CBIB7954.fwd CBIB_Daphnia_pulex_Chosen_One_Library_2 Daphnia pulex cDNA clone CBIB7954 5', mRNA sequence" (2011).
GenBank Accession No. FJ972198, "Solanum lycopersicum cultivar Ailsa Craig dihydropterin pyrophosphokinase-dihydropteroate synthase (HPPK-DHPS) gene, complete cds" (2010).
GenBank Accession No. GI:186478573 (2014).
GenEmbl Accession No. FJ861243 (2010).
Gomez-Zurita et al., "Recalibrated Tree of Leaf Beetles (Chrysomelidae) Indicates Independent Diversification of Angiosperms and Their Insect Herbivores," PLoS One, 4(e360):1-8 (2007).
Gong et al., "Silencing of Rieske iron-sulfur protein using chemically synthesised siRNA as a potential biopesticide against Plutella xylostella," Pest Manag Sci, 67:514-520 (2011).
Gressel et al., "A strategy to provide long-term control of weedy rice while mitigating herbicide resistance transgene flow, and its potential use for other crops with related weeds," Pest Manag Sci, 65(7):723-731 (2009).
Gutensohn et al., "Functional analysis of the two *Arabidopsis* homologues of Toc34, a component of the chloroplast protein import apparatus," The Plant Journal, 23(6):771-783 (2000).
Hagio, "Chapter 25: Direct Gene Transfer into Plant Mature Seeds via Electroporation After Vacuum Treatment," Electroporation and Sonoporation in Developmental Biology, p. 285-293 (2009).
Haigh, "The Priming of Seeds: Investigation into a method of priming large quantities of seeds using salt solutions," Thesis submitted to Macquarie University (1983).
Hamilton et al., "Guidelines for the Identification and Characterization of Plant Viruses," J. gen. Virol., 54:223-241 (1981).
Hamilton et al., "Two classes of short interfering RNA in RNA silencing," EMBO J., 21(17):4671-4679 (2002).
Han et al., "Molecular Basis for the Recognition of Primary microRNAs by the Drosha-DGCR8 Complex," Cell, 125(5):887-901 (2006).
Hannon, "RNA interference," Nature,481:244-251 (2002).
Hardegree, "Drying and storage effects on germination of primed grass seeds," Journal of Range Management, 47(3):196-199 (1994).
Harrison et al., "Does Lowering Glutamine Synthetase Activity in Nodules Modigy Nitrogen Metabolism and Growth of Lotus japonicus?," Plant Physiology, 133:253-262 (2003).
Herman et al., "A three-component dicamba O-demethylase from Pseudomonas maltophilia, strain DI-6: gene isolation, characterization, and heterologous expression," J. Biol. Chem., 280: 24759-24767 (2005).
Hess, "Surfactants and Additives," 1999 Proceedings of the California Weed Science Society, 51:156-172 (1999).
Hewezi et al., "Local infiltration of high- and low-molecular-weight RNA from silenced sunflower (*Helianthus annuus* L.) plants triggers post-transcriptional gene silencing in non-silenced plants," Plant Biotechnology Journal, 3:81-89 (2005).
Hidayat et al., "Enhanced Metabolism of Fluazifop Acid in a Biotype of Digitaria sanguinalis Resistant to the Herbicide Fluazifop-P-Butyl," Pesticide Biochem. Physiol., 57:137-146 (1997).
Himber et al., "Transitivity-dependant and -independent cell-to-cell movement of RNA silencing," The EMBO Journal, 22(17):4523-4533 (2003).
Hirschberg et al., "Molecular Basis of Herbicide Resistance in Amaranthus hybridus," Science, 222:1346-1349 (1983).
Hoekema et al., "A binary plant vector strategy based on separation of vir- and T-region of the Agrobacterium tumefaciens Ti-plasmid," Nature, 303:179-180 (1983).
Hoermann et al., "Tic32, as Essential Component in Chloroplast Biogenesis," The Journal of Biological Chemistry, 279(33):34756-34762 (2004).
Hofgen et al., "Repression of Acetolactate Synthase Activity through Antisense Inhibition: Molecular and Biochemical Analysis of Transgenic Potato (*Solanum tuberosum* L. cv *desiree*) Plants," Plant Physiol., 107(2):469-477 (1995).

(56) References Cited

OTHER PUBLICATIONS

Hsieh et al., "A library of siRNA duplexes targeting the phosphoinositide 3-kinase pathway: determinants of gene silencing for use in cell-based screens," Nucleic Acids Res., 32(3):893-901 (2004).
Huang et al., "In Vivo Analyses of the Roles of Essential Omp85-Related Proteins in the Chloroplast Outer Envelope Membrane," Plant Physiol., 157:147-159 (2011).
Huesken et al., "Design of a genome-wide siRNA library using an artificial neural network," Nature Biotechnology, 23(8): 995-1001 (2005).
Hunter et al., "RNA Interference Strategy to suppress Psyllids & Leafhoppers," International Plant and Animal Genome XIX, 15-19 (2011).
Ichihara et al., "Thermodynamic instability of siRNA duplex is a prerequisite for dependable prediction of siRNA activities," Nucleic Acids Res., 35(18):e123 (2007).
Inaba et al., "*Arabidopsis* Tic110 Is Essential for the Assembly and Function of the Protein Import Machinery of Plastids," The Plant Cell, 17:1482-1496 (2005).
IPRP (Chapter II) dated Jul. 24, 2015, in International Application No. PCT/US2014/047204.
International Preliminary Report on Patentability dated Sep. 11, 2014, in International Application No. PCT/IL2013/050447.
International Search Report and the Written Opinion dated Feb. 25, 2013, in International Application No. PCT/US2012/054883.
International Search Report and the Written Opinion dated Feb. 27, 2013, in International Application No. PCT/US2012/054814.
International Search Report and the Written Opinion dated Feb. 27, 2013, in International Application No. PCT/US2012/054842.
International Search Report and the Written Opinion dated Feb. 27, 2013, in International Application No. PCT/US2012/054862.
International Search Report and the Written Opinion dated Feb. 27, 2013, in International Application No. PCT/US2012/054894.
International Search Report and the Written Opinion dated Feb. 27, 2013, in International Application No. PCT/US2012/054974.
International Search Report and the Written Opinion dated Feb. 27, 2013, in International Application No. PCT/US2012/054980.
International Search Report and the Written Opinion dated Jul. 15, 2014, in International Application No. PCT/US2014/025305.
International Search Report and the Written Opinion dated Jul. 22, 2014, in International Application No. PCT/IL2013/051083.
International Search Report and the Written Opinion dated Jul. 22, 2014, in International Application No. PCT/IL2013/051085.
International Search Report and the Written Opinion dated Jul. 24, 2014, in International Application No. PCT/US2014/026036.
ISR/WO dated May 10, 2011, in International Application No. PCT/US2011/027528.
International Search Report and the Written Opinion dated Oct. 1, 2013, in International Application No. PCT/IL2013/050447.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report and Written Opinion dated Jul. 8, 2015, in International Application No. PCT/US2015/011408.
International Search Report and Written Opinion dated Mar. 26, 2015, in International Application No. PCT/US2014/069353.
International Search Report dated Mar. 12, 2013, in International Application No. PCT/US2012/054789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Isaacs et al., "Engineered riboregulators enable post-transcriptional control of gene expression," Nature Biotechnology, 22(7):841-847 (2004).

Ivanova et al., "Members of the Toc159 Import Receptor Family Represent Distinct Pathways for Protein Targeting to Plastids," Molecular Biology of the Cell, 15:3379-3392 (2004).
Jacque et al., "Modulation of HIV-1 replication by RNA interference," Nature, 418, 435-438 (2002).
Jang et al., "Resistance to herbicides caused by single amino acid mutations in acetyl-CoA carboxylase in resistant populations of grassy weeds," New Phytologist, 197(4):1110-1116 (2013).
Jarvis et al, "An *Arabidopsis* mutant defective in the plastid general protein import apparatus," Science, 282:100-103 (1998).
Ji et al., "Regulation of small RNA stability: methylation and beyond," Cell Research, 22:624-636 (2012).
Jones-Rhoades et al., "MicroRNAs and Their Regulatory Roles in Plants," Annu. Rev. Plant Biol., 57:19-53 (2006).
Josse et al., "A DELLA in Disguise: SPATULA Restrains the Growth of the Developing *Arabidopsis* Seedling," Plant Cell, 23:1337-1351 (2011).
Kam et al., "Nanotube Molecular Transporters: Internalization of Carbon Nanotube-Protein Conjugates into Mammalian Cells," J. Am. Chem. Soc., 126(22):6850-6851 (2004).
Katoh et al., "Specific residues at every third position of siRNA shape its efficient RNAi activity," Nucleic Acids Res., 35(4): e27 (2007).
Kertbundit et al., "In vivo random β-glucuronidase gene fusions in *Arabidopsis thaliana*," Proc. Natl. Acad. Sci. U S A., 88:5212-5216 (1991).
Khachigian, "DNAzymes: Cutting a path to a new class of therapeutics," Curr Opin Mol Ther 4(2):119-121 (2002).
Khan et al., "Matriconditioning of Vegetable Seeds to Improve Stand Establishment in Early Field Plantings," J. Amer. Soc. Hort. Sci., 117(1):41-47 (1992).
Khodakovskaya et al., "Carbon Nanotubes Are Able to Penetrate Plant Seed Coat and Dramatically Affect Seed Germination and Plant Growth," ACS Nano, 3(10):3221-3227 (2009).
Kim et al., "Synthetic dsRNA Dicer substrates enhance RNAi potency and efficacy," Nature Biotechnology, 23(2):222-226 (2005).
Kirkwood, "Use and Mode of Action of Adjuvants for Herbicides: A Review of some Current Work," Pestic Sci., 38:93-102 (1993).
Klahre et al., "High molecular weight RNAs and small interfering RNAs induce systemic posttranscriptional gene silencing in plants," Proc. Natl. Acad. Sci. USA, PNAS, 99(18):11981-11986 (2002).
Kovacheva et al., "Further in vivo studies on the role of the molecular chaperone, Hsp93, in plastid protein import," The Plant Journal, 50:364-379 (2007).
Kovacheva et al., "In vivo studies on the roles of Tic100, Tic40 and Hsp93 during chloroplast protein import," The Plant Journal, 41:412-428 (2005).
Kronenwett et al., "Oligodeoxyribonucleotide Uptake in Primary Human Hematopoietic Cells Is Enhanced by Cationic Lipids and Depends on the Hematopoietic Cell Subset," Blood, 91(3):852-862 (1998).
Kusaba et al., "Low glutelin content1: A Dominant Mutation That Suppresses the Glutelin Multigene Family via RNA Silencing ni Rice," The Plant Cell, 15(6):1455-1467 (2003).
Kusaba, "RNA interference in crop plants," Curr Opin Biotechnol, 15(2):139-143 (2004).
Lavigne et al., "Enhanced antisense inhibition of human immunodeficiency virus type 1 in cell cultures by DLS delivery system," Biochem Biophys Res Commun, 237:566-571 (1997).
Lee et al., "Aptamer Database," Nucleic Acids Research, 32:D95-D100 (2004).
Leopold et al., "Chapter 4: Moisture as a Regulator of Physiological Reaction in Seeds," Seed Moisture, CSSA Special Publication No. 14, pp. 51-69 (1989).
Lermontova et al., "Reduced activity of plastid protoporphyrinogen oxidase causes attenuated photodynamic damage during high-light compared to low-light exposure," The Plant Journal, 48(4):499-510 (2006).
Lesnik et al., "Prediction of rho-independent transcriptional terminators in *Escherichia coli*," Nucleic Acids Research, 29(17):3583-3594 (2001).

(56) References Cited

OTHER PUBLICATIONS

Li et al., "A Simplified Seed Transformation Method for Obtaining Transgenic *Brassica napus* Plants," Agricultural Sciences in China, 8(6):658-663 (2009).
Li et al., "Establishment of a highly efficient transformation system for pepper (*Capsicum annuum* L.)," Plant Cell Reports, 21: 785-788 (2003).
Li et al., "The FAST technique: a simplified Agrobacterium-based transformation method for transient gene expression analysis in seedlings of *Arabidopsis* and other plant species," Plant Methods, 5(6):1-15 (2009).
Liu et al., "Carbon Nanotubes as Molecular Transporters for Walled Plant Cells," Nano Letters, 9(3):1007-1010 (2009).
Liu et al., "Comparative study on the interaction of DNA with three different kinds of surfactants and the formation of multilayer films," Bioelectrochemistry, 70:301-307 (2007).
Liu et al., "DNAzyme-mediated recovery of small recombinant RNAs from a 5S rRNA-derived chimera expressed in *Escherichia coli*," BMC Biotechnology, 10:85 (2010).
Llave et al., "Endogenous and Silencing-Associated Small RNAs in Plants," The Plant Cell, 14:1605-1619 (2002).
Lu et al., "OligoWalk: an online siRNA design tool utilizing hybridization thermodynamics," Nucleic Acids Research, 36:W104-W108 (2008).
Lu et al., "RNA silencing in plants by the expression of siRNA duplexes," Nucleic Acids Res., 32(21):e171 (2004).
Luft, "Making sense out of antisense oligodeoxynucleotide delivery: getting there is half the fun," J Mol Med, 76:75-76 (1998).
Luque et al., "Water Permeability of Isolated Cuticular Membranes: A Structural Analysis," Archives of Biochemistry and Biophysics, 317(2):417-422 (1995).
Maas et al., "Mechanism and optimized conditions for PEG mediated DNA transfection into plant protoplasts," Plant Cell Reports, 8:148-149 (1989).
MacKenzie et al., "Transgenic Nicotiana debneyii expressing viral coat protein are resistant to potato virus S infection," Journal of General Virology, 71:2167-2170 (1990).
Maher III et al., "Inhibition of DNA binding proteins by oligonucleotide-directed triple helix formation," Science, 245(4919):725-730 (1989).
Makkouk et al., "Virus Diseases of Peas, Beans, and Faba Bean in the Mediterranean region," Adv Virus Res, 84:367-402 (2012).
Mandal et al., "Adenine riboswitches and gene activation by disruption of a transcription terminator," Nature Struct. Mol. Biol., 11(1):29-35 (2004).
Mandal et al., "Gene Regulation by Riboswitches," Nature Reviews | Molecular Cell Biology, 5:451-463 (2004).
Manoharan, "Oligonucleotide Conjugates as Potential Antisense Drugs with Improved Uptake, Biodistribution, Targeted Delivery, and Mechanism of Action," Antisense & Nucleic Acid Drug Development, 12:103-128 (2002).
Maori et al., "IAPV, a bee-affecting virus associated with Colony Collapse Disorder can be silenced by dsRNA ingestion," Insect Molecular Biology, 18(1):55-60 (2009).
Matveeva et al., "Prediction of antisense oligonucleotide efficacy by in vitro methods," Nature Biotechnology, 16:1374-1375 (1998).
Meinke, et al., "Identifying essential genes in *Arabidopsis thaliana*," Trends Plant Sci., 13(9):483-491 (2008).
Meins et al., "RNA Silencing Systems and Their Relevance to Plant Development," Annu. Rev. Cell Dev. Biol., 21:297-318 (2005).
Melnyk et al., "Intercellular and systemic movement of RNA silencing signals," The EMBO Journal, 30:3553-3563 (2011).
Misawa et al., "Functional expression of the Erwinia uredovora carotenoid biosynthesis gene crtI in transgenic plants showing an increase of β-carotene biosynthesis activity and resistance to the bleaching herbicide norflurazon," The Plant Journal, 4(5):8.
Miura et al., "The Balance between Protein Synthesis and Degradation in Chloroplasts Determines Leaf Variegation in *Arabidopsis* yellow variegated Mutants," The Plant Cell, 19:1313-1328 (2007).
Molina et al., "Inhibition of protoporphyrinogen oxidase expression in *Arabidopsis* causes a lesion-mimic phenotype that induces systemic acquired resistance," The Plant Journal, 17(6):667-678 (1999).
Molnar et al., "Plant Virus-Derived Small Interfering RNAs Originate redominantly from Highly Structured Single-Stranded Viral RNAs," Journal of Virology, 79(12):7812-7818 (2005).
Molnar et al., "Small Silencing RNAs in Plants Are Mobile and Direct Epigenetic Modification in Recipient Cells," Science, 328:872-875 (2010).
Moriyama et al., "Double-stranded RNA in rice: a novel RNA replicon in plants," Molecular & General Genetics, 248(3):364-369 (1995).
Moriyama et al., "Stringently and developmentally regulated levels of a cytoplasmic double-stranded RNA and its high-efficiency transmission via egg and pollen in rice," Plant Molecular Biology, 31:713-719 (1996).
Morrissey et al., "Potent and persistent in vivo anti-HBV activity of chemically modified siRNAs," Nat Biotechnol. 23(8):1002-1007 (2005).
Moser et al., "Sequence-Specific Cleavage of Double Helical DNA by Triple Helix Formation," Science, 238:645-646 (1987).
Non-Final Office Action dated Apr. 11, 2013, in U.S. Appl. No. 13/042,856.
Non-Final Office Action dated Aug. 12, 2015, in U.S. Appl. No. 13/612,936.
Non-Final Office Action dated Jul. 30, 2014, in U.S. Appl. No. 13/042,856.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated May 15, 2015, in U.S. Appl. No. 14/608,951.
Nowak et al., "A new and efficient method for inhibition of RNA viruses by DNA interference," The FEBS Journal, 276:4372-4380 (2009).
Office Action dated Aug. 1, 2017, in European Patent Application No. 12 830 932.5.
Office Action dated Aug. 28, 2013, in Chinese Patent Application No. 201180012795.2.
Office Action dated Aug. 3, 2017, in European Patent Application No. 12 831 684.1.
Office Action dated Feb. 17, 2014, in Mexican Patent Application No. MX/a/2012/010479.
Office Action dated Feb. 24, 2014, in Eurasian Patent Application No. 201201264.
Office Action dated May 3, 2016, in Chilean Patent Application No. 201601057.
Office Action dated Nov. 3, 2014, in Chinese Patent Application No. 201180012795.2.
Office Action dated Jan. 6, 2015, in Japanese Patent Application No. 2012-557165.
Office Action dated Nov. 19, 2014, in Eurasian Patent Application No. 201201264/28.
Ongvarrasopone et al., "A Simple and Cost Effective Method to Generate dsRNA for RNAi Studies in Invertebrates," Science Asia, 33:35-39 (2007).
Orbović et al., "Foliar-Applied Surfactants and Urea Temporarily Reduce Carbon Assimilation of Grapefruit Leaves," J. Amer. Soc. Hort. Sci., 126(4):486-490 (2001).
Ouellet et al., "Members of the Acetohydroxyacid Synthase Muligene Family of *Brassica napus* Have Divergent Patterns of Expression," The Plant Journal, Blackwell Scientific Publications, Oxford, GB, 2(3):321-330 (1992).
Paddison et al., "Stable suppression of gene expression by RNAi in mammalian cells," Proc. Natl Acad. Sci. USA, 99(3):1443-1448 (2002).
Palauqui et al., "Activation of systemic acquired silencing by localised introduction of DNA," Current Biology, 9:59-66 (1999).
Parera et al., "Dehydration Rate after Solid Matrix Priming Alters Seed Performance of Shrunken-2 Corn," J. Amer. Soc. Hort. Sci., 119(3):629-635 (1994).

(56) References Cited

OTHER PUBLICATIONS

Partial European Search Report dated Dec. 6, 2017, in European Patent Application No. 17181861.0.
Partial Supplementary European Search Report dated Mar. 2, 2015, in European Patent Application No. 12 831 494.5.
Patent Examination Report No. 1 dated Jun. 8, 2017, in Australian Patent Application No. 2012308686.
Paungfoo-Lonhienne et al., "DNA is Taken up by Root Hairs and Pollen, and Stimulates Root and Pollen Tube Growth," Plant Physiology, 153:799-805 (2010).
Paungfoo-Lonhienne et al., "DNA uptake by *Arabidopsis* induces changes in the expression of CLE peptides which control root morphology," Plant Signaling & Behavior, 5(9):1112-1114 (2010).
Pei et al., "On the art of identifying effective and specific siRNAs," Nature Methods, 3(9):670-676 (2006).
Peretz et al., "A Universal Expression/Silencing Vector in Plants," Plant Physiology, 145:1251-1263 (2007).
Pornprom et al., "Glutamine synthetase mutation conferring target-site-based resistance to glufosinate in soybean cell selections," Pest Manag Sci, 2009; 65(2):216-222 (2009).
Pratt et al., "Amaranthus rudis and *A. tuberculatus*, One Species or Two?," Journal of the Torrey Botanical Society, 128(3):282-296 (2001).
Preston et al., "Multiple effects of a naturally occurring proline to threonine substitution within acetolactate synthase in two herbicide-resistant populations of Lactuca serriola," Pesticide Biochem. Physiol., 84(3):227-235 (2006).
Qichuan et al., Seed Science, China Agriculture Press, pp. 101-103, Tables 2-37.
Qiwei, "Advance in DNA interference," Progress in Veterinary Medicine, 30(1):71-75 (2009).
Rajur et al., "Covalent Protein—Oligonucleotide Conjugates for Efficient Delivery of Antisense Molecules," Bioconjug Chem., 8:935-940 (1997).
Rakoczy-Trojanowska, "Alternative Methods of Plant Transformation—a short review," Cellular & Molecular Biology Letters, 7:849-858 (2002).
Reddy et al "Organosilicone Adjuvants Increased the Efficacy of Glyphosate for Control of Weeds in Citrus (*Citrus* spp.)" HortScience 27(9):1003-1005 (1992).
Reddy et al., "Aminomethylphosphonic Acid Accumulation in Plant Species Treated with Glyphosate," J. Agric. Food Chem., 56(6):2125-2130 (2008).
Reither et al., "Specificity of DNA triple helix formation analyzed by a FRET assay," BMC Biochemistry, 3:27 (2002).
Restriction Requirement dated Mar. 12, 2015, in U.S. Appl. No. 13/612,948.
Restriction Requirement dated Mar. 4, 2015, in U.S. Appl. No. 13/612,941.
Restriction Requirement dated May 4, 2015, in U.S. Appl. No. 13/612,929.
Restriction Requirement dated May 5, 2015, in U.S. Appl. No. 13/612,936.
Restriction Requirement dated May 7, 2015, in U.S. Appl. No. 13/612,925.
Restriction Requirement dated May 7, 2015, in U.S. Appl. No. 13/612,995.
Restriction Requirement dated Oct. 2, 2012, in U.S. Appl. No. 13/042,856.
Restriction Requirement dated Oct. 21, 2014, in U.S. Appl. No. 13/583,302.
Rey et al., "Diversity of Dicotyledenous-Infecting Geminiviruses and Their Associated DNA Molecules in Southern Africa, Including the South-West Indian Ocean Islands," Viruses, 4:1753-1791 (2012).
Reynolds et al., "Rational siRNA design for RNA interference," Nature Biotechnology, 22:326-330 (2004).
Richardson et al., "Targeting and assembly of components of the TOC protein import complex at the chloroplast outer envelope membrane," Frontiers in Plant Science, 5:1-14 (2014).
Riggins et al., "Characterization of de novo transcriptome for waterhemp (*Amaranthus tuberculatus*) using GS-FLX 454 pyrosequencing and its application for studies of herbicide target-site genes," Pest Manag. Sci., 66:1042-1052 (2010).
Rose et al., "Functional polarity is introduced by Dicer processing of short substrate RNAs," Nucleic Acids Research, 33(13):4140-4156 (2005).
Rothnie et al., Pararetroviruses and Retroviruses: A Comparative Review of Viral Structure and Gene Expression Strategies, Advances in Virus Research, 44:1-67 (1994).
Ryabov et al., "Cell-to-Cell, but Not Long-Distance, Spread of RNA Silencing That Is Induced in Individual Epidermal Cells," Journal of Virology, 78(6):3149-3154 (2004).
Ryan, "Human endogenous retroviruses in health and disease: a symbiotic perspective," Journal of the Royal Society of Medicine, 97:560-565 (2004).
Santoro et al., "A general purpose RNA-cleaving DNA enzyme," Proc. Natl. Acad. Sci. USA, 94:4262-4266 (1997).
Sathasivan et al., "Nucleotide sequence of a mutant acetolactate synthase gene from an imidazolinone-resistant *Arabidopsis thaliana* var. *columbia*," Nucleic Acids Research, 18(8):2188-2193 (1990).
Schönherr, "Water Permeability of Isolated Cuticular Membranes: The Effect of pH and Cations on Diffusion, Hydrodynamic Permeability and Size of Polar Pores in the Cutin Matrix," Planta, 128:113-126 (1976).
Schwab et al., "RNA silencing amplification in plants: Size matters," PNAS, 107(34):14945-14946 (2010).
Schweizer et al., "Double-stranded RNA interferes with gene function at the single-cell level in cereals," The Plant Journal, 24(6):895-903 (2000).
Schwember et al., "Drying Rates following Priming Affect Temperature Sensitivity of Germination and Longevity of Lettuce Seeds," HortScience, 40(3):778-781 (2005).
Search Report dated Jul. 24, 2017, in Chinese Patent Application No. 201480014392.5 (with English translation).
Search Report dated Oct. 20, 2017, in Chinese Patent Application No. 201380039346.6.
Second Chinese Office Action dated Jun. 10, 2014, in Chinese Patent Application No. 201180012795.2.
Seidman et al., "The potential for gene repair via triple helix formation," J Clin Invest., 112(4):487-494 (2003).
Selvarani et al., "Evaluation of seed priming methods to improve seed vigour of onion (*Allium cepa* cv. *aggregatum*) and carrot (*Daucus carota*)," Journal of Agricultural Technology, 7(3):857-867 (2011).
Senthil-Kumar et al., "A systematic study to determine the extent of gene silencing in Nicotiana benthamiana and other *Solanaceae* species when heterologous gene sequences are used for virus-induced gene silencing," New Phytologist, 176:782-791 (2007).
Sharma et al., "A simple and efficient Agrobacterium-mediated procedure for transformation of tomato," J. Biosci., 34(3):423 433 (2009).
Sijen et al., "On the Role of RNA Amplification in dsRNA-Triggered Gene Silencing," Cell, 107:465-476 (2001)..
Silwet L-77 Spray Adjuvant for agricultural applications, product description from Momentive Performance Materials, Inc. (2003).
Singh et al., "Absorption and translocation of glyphosate with conventional and organosilicone adjuvants," Weed Biology and Management, 8:104-111 (2008).
Snead et al., "Molecular basis for improved gene silencing by Dicer substrate interfering RNA compared with other siRNA variants," Nucleic Acids Research, 41(12):6209-6221 (2013).
Statement of Grounds and Particulars dated Sep. 1, 2017, in Australian Patent No. 2014262189.
Steeves et al., "Transgenic soybeans expressing siRNAs specific to a major sperm protein gene suppress Heterodera glycines reproduction," Funct. Plant Biol., 33:991-999 (2006).
Stevens et al., "New Formulation Technology—Silwet® Organosilicone Surfactants Have Physical and Physiological Properties Which Enhance the Performance of Sprays," Proceedings of the 9th Australian Weeds Conference, pp. 327-331 (1990).

(56) References Cited

OTHER PUBLICATIONS

Stevens, "Formulation of Sprays to Improve the Efficacy of Foliar Fertilisers," New Zealand Journal of Forestry Science, 24(1):27-34 (1994).
Stevens, "Organosilicone Surfactants as Adjuvants for Agrochemicals," New Zealand Journal of Forestry Science, 24:27-34 (1993).
Stock et al., "Possible Mechanisms for Surfactant-Induced Foliar Uptake of Agrochemicals," Pestic. Sci., 38:165-177 (1993).
Strat et al., "Specific and nontoxic silencing in mammalian cells with expressed long dsRNAs," Nucleic Acids Research, 34(13):3803-3810 (2006).
Street, "Why is DNA (and not RNA) a stable storage form for genetic information?," Biochemistry Revisited, pp. 1-4 (2008).
Sudarsan et al., "Metabolite-binding RNA domains are present in the genes of eukaryotes," RNA, 9:644-647 (2003).
Summons to Attend Oral Proceedings Pursuant to Rule 115(1) EPC, dated Aug. 7, 2017, in European Patent Application No. 12832160.1.
Sun et al., "A Highly efficient Transformation Protocol for Micro-Tom, a Model Cultivar for Tomato Functional Genomics," Plant Cell Physiol., 47(3):426-431 (2006).
Sun et al., "Antisense oligodeoxynucleotide inhibition as a potent strategy in plant biology: identification of SUSIBA2 as a transcriptional activator in plant sugar signalling," The Plant Journal, 44:128-138 (2005).
Sun et al., "Sweet delivery—sugar translocators as ports of entry for antisense oligodeoxynucleotides in plant cells," The Plant Journal, 52:1192-1198 (2007).
Sutton et al., "Activity of mesotrione on resistant weeds in maize," Pest Manag. Sci., 58:981-984 (2002).
Takasaki et al., "An Effective Method for Selecting siRNA Target Sequences in Mammalian Cells," Cell Cycle, 3:790-795 (2004).
Tank Mixing Chemicals Applied to Peanut Crops: Are the Chemicals Compatible?, College of Agriculture & Life Sciences, NC State University, AGW-653, pp. 1-11 (2004).
Taylor, "Seed Storage, Germination and Quality," The Physiology of Vegetable Crops, pp. 1-36 (1997).
Temple et al., "Can glutamine synthetase activity levels be modulated in transgenic plants by the use of recombinant DNA technology?" Transgenic Plants and Plant Biochemistry, 22(4):915-920 (1994).
Temple et al., "Down-regulation of specific members of the glutamine synthetase gene family in Alfalfa by antisense RNA technology," Plant Molecular Biology, 37:535-547 (1998).
Templeton et al., "Improved DNA: liposome complexes for increased systemic delivery and gene expression," Nature Biotechnology, 15:647-652 (1997).
Teng et al., "Tic21 Is an Essential Translocon Component for Protein Translocation across the Chloroplast Inner Envelope Membrane," The Plant Cell, 18:2247-2257 (2006).
Tenllado et al., "Crude extracts of bacterially expressed dsRNA can be used to protect plants against virus infection," BMC Biotechnology, 3(3):1-11 (2003).
Tenllado et al., "RNA interference as a new biotechnological tool for the control of virus diseases in plants," Virus Research, 102:85-96 (2004).
Tepfer, "Risk assessment of virus resistant transgenic plants," Annual Review of Phytopathology, 40:467-491 (2002).
Third Party Submission filed on Nov. 29, 2012 in U.S. Appl. No. 13/042,856.
Thompson, et al., "CLUSTAL W: improving the sensitivity of progressive multiple sequence alignment through sequence weighting, position-specific gap penalties and weight matrix choice," Nucl. Acids Res., 22(22):4673-4680 (1994).
Timmons et al., "Specific interference by ingested dsRNA," Nature, 395:854 (1998).
Tomari et al., "Perspective: machines for RNAi," Genes & Dev., 19:517-529 (2005).
Töpfer et al., "Uptake and Transient Expression of Chimeric Genes in Seed-Derived Embryos," Plant Cell, 1:133-139 (1989).
Toriyama et al., "Transgenic Rice Plants After Direct Gene Transfer Into Protoplasts," Bio/Technology, 6:1072-1074 (1988).
Tran et al., "Control of specific gene expression in mammalian cells by co-expression of long complementary RNAs," FEBS Lett.;573(1-3):127-134 (2004).
Tranel et al., "Resistance of weeds to ALS-inhibiting herbicides: what have we learned?," Weed Science, 50:700-712 (2002).
Trucco et al., "Amaranthus hybridus can be pollinated frequently by *A. tuberculatus* under filed conditions," Heredity, 94:64-70 (2005).
Tsugawa et al., "Efficient transformation of rice protoplasts mediated by a synthetic polycationic amino polymer," Theor Appl Genet, 97:1019-1026 (1998).
Turina et al., "Tospoviruses in the Mediterranean Area," Advances in Virus Research, 84:403-437 (2012).
Tuschl, "Expanding small RNA interference," Nature Biotechnol., 20: 446-448 (2002).
Tuschl, "RNA Interference and Small Interfering RNAs," ChemBiochem. 2(4):239-245 (2001).
Ui-Tei et al., "Guidelines for the selection of highly effective siRNA sequences for mammalian and chick RNA interference," Nucleic Acids Res., 32(3): 936-948 (2004).
Ulrich et al., "Large scale RNAi screen in Tribolium reveals novel target genes for pest control and the proteasome as prime target," BMC genomics, 16(1):671 (2015).
Unnamalai et al., "Cationic oligopeptide-mediated delivery of dsRNA for post-transcriptional gene silencing in plant cells," FEBS Letters, 566:307-310 (2004).
Unniraman et al., "Alternate Paradigm for Intrinsic Transcription Termination in Eubacteria," The Journal of Biological Chemistry, 276(45)(9):41850-41855 (2001).
Unniraman et al., "Conserved Economics of Transcription Termination in Eubacteria," Nucleic Acids Research, 30(3):675-684 (2002).
Urayama et al., "Knock-down of OsDCL2 in Rice Negatively Affects Maintenance of the Endogenous dsRNA Virus, *Oryza sativa* Endornavirus," Plant and Cell Physiology, 51(1):58-67 (2010).
Van de Wetering et al., "Specific inhibition of gene expression using a stably integrated, inducible small-interfering-RNA vector," EMBO Rep., 4(6):609-615 (2003).
Vasil et al., "Herbicide Resistant Fertile Transgenic Wheat Plants Obtained by Microprojectile Bombardment of Regenerable Embryogenic Callus," Bio/Technology,10:667-674 (1992).
Vaucheret, "Post-transcriptional small RNA pathways in plants: mechanisms and regulations," Genes Dev., 20:759-771 (2006).
Vencill et al., "Resistance of Weeds to Herbicides," Herbicides and Environment, 29:585-594 (2011).
Verma et al., "Modified oligonucleotides: synthesis and strategy for users," Annu. Rev. Biochem., 67:99-134 (1998).
Vermeulen et al., "The contributions of dsRNA structure to Dicer specificity and efficiency," RNA, 11(5):674-682 (2005).
Vert et al., "An accurate and interpretable model for siRNA efficacy prediction," BMC Bioinformatics, 7:520 (2006).
Voinnet et al., "Systemic Spread of Sequence-Specific Transgene RNA Degradation in Plants Is Initiated by Localized Introduction of Ectopic Promoterless DNA," Cell, 95:177-187 (1998).
Voinnet, "Origin, Biogenesis, and Activity of Plant MicroRNAs," Cell, 136:669-687 (2009).
Wakelin et al., "A target-site mutation is present in a glyphosate-resistant Lolium rigidum population," Weed Res. (Oxford), 46(5):432-440 (2006).
Walton et al., "Prediction of antisense oligonucleotide binding affinity to a structured RNA target," Biotechnol Bioeng 65(1):1-9 (1999).
Wan et al., "Generation of Large Numbers of Independently Transformed Fertile Barley Plants," Plant Physiol., 104:37-48 (1994).
Wardell, "Floral Induction of Vegetative Plants Supplied a Purified Fraction of Deoxyribonucleic Acid from Stems of Flowering Plants," Plant Physiol, 60:885-891 (1977).
Wardell,"Floral Activity in Solutions of Deoxyribonucleic Acid Extracted from Tobacco Stems," Plant Physiol, 57:855-861 (1976).
Waterhouse et al., "Virus resistance and gene silencing in plants can be induced by simultaneous expression of sense and antisense RNA," Proc Natl Acad Sci USA, 95 13959-13964 (1998).

(56) References Cited

OTHER PUBLICATIONS

Welch et al., "Expression of ribozymes in gene transfer systems to modulate target RNA levels," Curr Opin Biotechnol. 9(5):486-496 (1998).
Wilson, et al., "Transcription termination at intrinsic terminators: The role of the RNA hairpin," Proc. Natl. Acad. Sci. USA, 92:8793-8797 (1995).
Winkler et al., "Thiamine derivatives bind messenger RNAs directly to regulate bacterial gene expression," Nature, 419:952-956 (2002).
Wool et al., "Structure and evolution of mammalian ribosomal proteins," Biochem. Cell Biol., 73:933-947 (1995).
Written Opinion dated May 8, 2014, in International Application No. PCT/IL2013/050447.
Written Opinion dated Sep. 1, 2014, in Singapore Patent Application No. 201206152-9.
Xu et al., "Characterization and Functional Analysis of the Calmodulin-Binding Domain of Rac1 GTPase," PLoS One, 7(8):e42975 (2012).
Yin et al., "Production of double-stranded RNA for interference with TMV infection utilizing a bacterial prokaryotic expression system," Appl. Microbiol. Biotechnol., 84(2):323-333 (2009).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," PNAS, 98(12):6617-6622 (2001).
Zaimin et al., Botany, Northwest A&F University Press, pp. 87-92.
Zhang et al., "A novel rice gene, NRR responds to macronutrient deficiency and regulates root growth," Mol Plant, 5(1):63-72 (2012).
Zhang et al., "Agrobacterium-mediated transformation of *Arabidopsis thaliana* using the floral dip method," Nature Protocols, 1(2):1-6 (2006).
Zhang et al., "Cationic lipids and polymers mediated vectors for delivery of siRNA," Journal of Controlled Release, 123:1-10 (2007).
Zhang et al., "DEG: a database of essential genes," Nucleic Acids Res., 32:D271-D272 (2004).
Zhang et al., "Transgenic rice plants produced by electroporation-mediated plasmid uptake into protoplasts," The Plant Cell Rep., 7:379-384 (1988).
Zhao et al., "*Phyllotreta striolata* (Coleoptera: Chrysomelidae):Arginine kinase cloning and RNAi-based pest control," European Journal of Entomology, 105(5):815-822 (2008).
Zhong et al., "A forward genetic screen to explore chloroplast protein import in vivo identifies Moco sulfurase, pivotal for ABA and IAA biosynthesis and purine turnover," The Plant Journal, 63:44-59 (2010).
Zhong et al., "A pea antisense gene for the chloroplast stromal processing peptidase yields seedling lethals in *Arabidopsis*: survivors show defective GFP import in vivo," The Plant Journal, 34:802-812 (2003).
Zhu et al., "Ingested RNA interference for managing the populations of the Colorado potato beetle, *Leptinotarsa decemlineata*," Pest Manag Sci, 67:175-182 (2010).
Zotti et al., "RNAi technology for insect management and protection of beneficial insects from diseases: lessons, challenges and risk assessments," Neotropical Entomology, 44(3):197-213 (2015).
Cheng et al., "Transient Expression of Minimum Linear Gene Cassettes in Onion Epidermal Cells via Direct Transformation," Appl Biochem Biotechnol, 159:739-749 (2009).
Colorado Potato Beetle, *Leptinotarsa decemlineata*,Transcriptome, PLoS One, 9(1):e86012 (2014).
Communication Pursuant to Article 94(3) EPC dated Sep. 5, 2018, in European Patent Application No. 17152830.0.
Database EMBL XP-002781749(BG442539) dated Mar. 20, 2001.
Egli et al., "A Maize Acetyl-Coenzyme A Carboxylase cDNA Sequence," Plant Physiol., 108: 1299-1300 (1995).

European Search Report dated Jun. 29, 2018, in European Patent Application No. 18157745.3.
Examination Report dated Mar. 1, 2018, in Australian Patent Application No. 2013264742.
Extended European Search Report dated Apr. 13, 2018, in European Patent Application No. 15812530.0.
Extended European Search Report dated Mar. 15, 2018, in European Patent Application No. 17181861.0.
Friedberg, "Automated protein function prediction—the genomic challenge," *Briefings in Bioinformatics*, 7(3):225-242 (2006).
Funke et al., "Molecular basis for herbicide resistance in Roundup Ready crops," PNAS, 103:13010-13015 (2006).
Gasser et al., "Structure, Expression, and Evolution of the 5-Enolpyruvylshikimate-3-phosphate Synthase Genes of Petunia and Tomato," J. Biol. Chem., 263: 4280-4287 (1988).
Hu et al., "High efficiency transport of quantum dots into plant roots with the aid of silwet L-77," Plant Physiology and Biochemistry, 48:703-709 (2010).
Liu et al, "The Helicase and RNaseIIIa Domains of *Arabidopsis* Dicer-Like1 Modulate Catalytic Parameters during MicroRNA Biogenesis," *Plant Physiology*, 159:748-758 (2012)
Liu, "Calmodulin and Cell Cycle," Foreign Medical Sciences Section of Pathophysiology and Clinical Medicine, 18(4):322-324 (1998).
Liu, "The Transformation of Nucleic Acid Degradants in Plants," China Organic Fertilizers, Agriculture Press, ISBN: 7-1091634 (with English translation).
Lodish et al., Molecular Cell Biology, Fourth Edition, p. 210 (2000).
McGinnis, "RNAi for functional genomics in plants," Brief Funct Genomics, 9(2):111-7 (2010).
Non-Final Office Action dated Aug. 13, 2015, in U.S. Appl. No. 13/612,929.
Non-Final Office Action dated Jul. 23, 2015, in U.S. Appl. No. 14/335,135.
Non-Final Office Action dated Mar. 21, 2018, in U.S. Appl. No. 13/619,980.
Non-Final Office Action dated Mar. 30, 2015, in U.S. Appl. No. 13/583,302.
Non-Final Office Action dated Nov. 9, 2016, in U.S. Appl. No. 14/901,003.
Office Action dated Aug. 14, 2017, in Israeli Patent Application No. 235878.
Office Action dated Aug. 22, 2017, in Korean Patent Application No. 10-2012-7023415.
Office Action dated Aug. 3, 2017, in Chinese Patent Application No. 201480014392.5 (with English translation).
Office Action dated Aug. 8, 2017, in Chilean Patent Application No. 201501874.
Office Action dated Aug. 9, 2018, in Canadian Patent Application No. 2,848,371.
Office Action dated Dec. 13, 2016, in Ukrainian Patent Application No. a 2014 03843.
Office Action dated Dec. 14, 2016, in Ukrainian Patent Application No. a 2014 03850.
Office Action dated Dec. 15, 2016, in Ukrainian Patent Application No. a 2014 03845.
Office Action dated Dec. 15, 2016, in Ukrainian Patent Application No. a 2014 03852.
Office Action dated Dec. 15, 2016, in Ukrainian Patent Application No. a 2014 03849.
Office Action dated Dec. 27, 2016, in Ukrainian Patent Application No. a 2012 11548.
Office Action dated Dec. 5, 2017, in Japanese Patent Application No. 2016-502033.
Office Action dated Feb. 21, 2018, in Mexican Patent Application No. MX/a/2015/012632 (with English translation).
Office Action dated Jul. 11, 2017, in Mexican Patent Application No. MX/a/2015/013118 (with English translation).
Office Action dated Jul. 3, 2017, in Mexican Patent Application No. MX/a/2015/012632 (with English translation).
Office Action dated Jul. 30, 2018, in Canadian Patent Application No. 2,848,576.

(56) References Cited

OTHER PUBLICATIONS

Office Action dated Jul. 6, 2017, in Mexican Patent Application No. MX/a/2015/013103 (with English translation).
Office Action dated Mar. 16, 2017, in Chinese Patent Application No. 201280054819.5.
Office Action dated Mar. 8, 2018 (with English translation), in Chilean Patent Application No. 201403192.
Office Action dated Nov. 15, 2016, in Mexican Patent Application No. MX/a/2014/003068 (with English translation).
Office Action dated Sep. 5, 2016, in Ukrainian Patent Application No. a 2014 03846.
Office Action dated Sep. 6, 2017, in Chinese Patent Application No. 2014800154012 (with English translation).
Partial Supplementary European Search Report dated Jan. 11, 2018, in European Patent Application No. 15812530.0.
Powles et al., "Evolution in Action: Plants Resistant to Herbicides," *Annual Review of Plant Biology*, 61(1):317-347 (2010).
Restriction Requirement dated Apr. 21, 2015, in U.S. Appl. No. 13/612,954.
Reverdatto et al., "A Multisubunit Acetyl Coenzyme A Carboxylase from Soybean," *Plant Physiol.*, 119: 961-978 (1999).
Schönherr et al., "Size selectivity of aqueous pores in astomatous cuticular membranes isolated from *Populus canescens* (Aiton) Sm. leaves," *Planta*, 2004, 219: 405-411.
Tice, "Selecting the right compounds for screening: does Lipinski's rule of 5 for pharmaceuticals apply to agrochemicals?" *Pest Manag. Sci.*, 2001, 57: 3-16.
Watson et al., "RNA silencing platforms in plants," *FEBS Lett.*, 579: 5982-5987 (2005).
Zhang et al., "Development and Validation of Endogenous Reference Genes for Expression Profiling of Medaka (*Oryzias latipes*) Exposed to Endocrine Disrupting Chemicals by Quantitative Real-Time RT-PCR," *Toxicological Sciences*, 95(2):356-368 (2007).
Zhang et al., "Progress in research of honey bee mite *Varro destructor*," *Journal of Environmental Entomology*, 34(3):345-353 (2012).
Asad et al., "Silicon Carbide Whisker-mediated Plant Transformation," Properties and Applications of Silicon Carbide, pp. 345-358 (2011).
Bauer et al., "The major protein import receptor of plastids is essential for chloroplast biogenesis," Nature, 403:203-207 (2000).
Baulcombe, "RNA silencing in plants," Nature, 431:356-363 (2004).
Baum et al., "Progress Towards RNAi-Mediated Insect Pest Management," Advances in Insect Physiology, 47:249-295 (2014).
Bedell et al., "Sorghum Genome Sequencing by Methylation Filtration," PLOS Biology, 3(1):E13/104-115 (2005).
Belhadj et al., "Methyl Jasmonate Induces Defense Responses in Grapevine and Triggers Protection against *Erysiphe necator*," J. Agric Food Chem., 54:9119-9125 (2006).
Chen et al., "Exploring MicroRNA-Like Small RNAs in the Filamentous Fungus *Fusarium oxysporum*," PLOS One, 9(8):e104956:1-10 (2014).
Chang et al., "Dual-target gene silencing by using long, sythetic siRNA duplexes without triggering antiviral responses," Molecules and Cells, 27(6)689-695 (2009).
Cong et al., "Multiplex Genome Engineering Using CRISPR/Cas Systems," Science, 339:819-823 (2013).
Declaration of Jerzy Zabkiewicz executed Nov. 28, 2017, as filed by Opponent in Australian Patent Application No. 2014262189, pp. 1-4.
Declaration of Jerzy Zabkiewicz executed Nov. 28, 2017, as filed by Opponent in Australian Patent Application No. 2014262189, pp. 1-73.
Declaration of Neena Mitter executed Nov. 30, 2017, as filed by Opponent in Australian Patent Application No. 2014262189, pp. 1-114.
Declaration of Neena Mitter executed Nov. 30, 2017, as filed by Opponent in Australian Patent Application No. 2014262189, pp. 1-25.

Delye et al., "PCR-based detection of resistance to acetyl-CoA carboxylase-inhibiting herbicides in black-grass (*Alopecurus myosuroides* Huds) and ryegrass (*Lolium rigidum* Gaud)," Pest Management Science, 58:474-478 (2002).
Delye et al., "Variation in the gene encoding acetolactate-synthase in *Lolium* species and proactive detection of mutant, herbicide-resistant alleles," Weed Research, 49:326-336 (2009).
Desveaux et al., "PBF-2 Is a Novel Single-Stranded DNA Binding Factor Implicated in PR-10a Gene Activation in Potato," The Plant Cell, 12:1477-1489 (2000).
Dietzgen et al., "Transgenic gene silencing strategies for virus control," Australasian Plant Pathology, 35:605-618 (2006).
Dilpreet et al., "Glyphosate Rsistance in a Johnsongrass (*Sorghum halepense*) Biotype from Arkansas," Weed Science, 59(3):299-304 (2011).
Drobyazko R.V., "Reliable and environmentally friendly insecticide," Protection and quarantine of plants, 2012 (pp. 52, 53) (in Russian).
Duhoux et al., "Reference Genes to Study Herbicide Stress Response in *Lolium* sp.: Up-Regulation of P3450 Genes in Plants Resistant to Acetolactate-Synthase Inhibitors," PLOS One, 8(5):e63576 (2013).
European Search Report dated Sep. 7, 2017, in European Patent Application No. 17152830.0.
Extended European Search Report dated Dec. 19, 2018, in European Patent Application No. 16804395.8.
Extended European Search Report dated Nov. 16, 2018, in European Patent Application No. 18182238.8.
Extended European Search Report dated Nov. 21, 2018, in European Patent Application No. 18175809.5.
Extended European Search Report dated Sep. 28, 2018, in European Patent Application No. 16740770.9.
Fridlund, "Distribution of chlorotic leaf spot virus in apple budsticks," *Plant Dis. Reptr.*, 57: 865-869 (1973).
Gao et al., "DNA-guided genome editing using the Natronobacterium gregoryi Argonaute," Nature Biotechnology, 34(7):768-773 (2016).
Guttieri et al., "DNA Sequence Variation in Domain A of the Acetolactate Synthase Genes of Herbicide-Resistant and -Susceptible Weed Biotypes," Weed Science, 40:670-679 (1992).
Horsch et al., "Inheritance of Functional Foreign Genes in Plants," Science, 223:496-498 (1984).
Hsu et al., "DNA targeting specificity of RNA-guided Cas9 nucleases," Nature Biotechnology, 31:827-832 (2013).
Huggett et al., "Real-time RT-PCR normalisation; strategies and considerations," Genes and Immunity, 6:279-284 (2005).
International Preliminary Report on Patentability (Chapter II) dated Jul. 24, 2015, in International Application No. PCT/US2014/047204.
International Search Report and the Written Opinion dated May 10, 2011, in International Application No. PCT/US2011/027528.
International Search Report dated Oct. 13, 2016, in International Patent Application No. PCT/US2016/35500.
Jiang et al., Chapter III Seeds and Seedlings, Botany, Northwest A&F University Press, pp. 87-92 (2009).
Kikkert et al., "Stable Transformation of Plant Cells by Particle Bombardment/Biolistics," Methods in Molecular Biology, 286:61-78 (2005).
Kim et al., "Synthesis and characterization of mannosylated pegylated polyethylenimine as a carrier for siRNA," International Journal of Pharmaceutics, 427:123-133 (2012).
Kirkwood, "Recent developments in our understanding of the plant cuticle as a barrier to the foliar uptake of pesticides," Pestic Sci, 55:69-77 (1999).
Liu, "Confocal laser scanning microscopy—an attractive tool for studying the uptake of xenobiotics into plant foliage," Journal of Microscopy, 213(Pt 2):87-93 (2004).
Liu, "The Transformation of Nucleic Acid Degradants in Plants," China Organic Fertilizers, Agriculture Press, ISBN: 7-1091634 (1991) (with English translation).
Lucas et al., "Plasmodesmata—bridging the gap between neighboring plant cells," Trends in Cell Biology, 19:495-503 (2009).

(56) References Cited

OTHER PUBLICATIONS

Morozov et al., "Evaluation of Preemergence Herbicides for Control of Diclofop-resistant Italian Ryegrass (*Lolium multiflorum*) in Virginia," Virginia Polytechnic Institute and State University, pp. 43-71 (2004).
Office Action dated Sep. 20, 2018, in Chilean Patent Application No. 201601440 (with English translation).
Partial European Search Report dated Jun. 29, 2018, in European Patent Application No. 18157745.3.
Partial Supplementary European Search Report dated Jan. 11, 2018, in European Patent Application No. 15812530.2.
Pratt et al., "Sorghum Expressed Sequence Tags Identify Signature Genes for Drought, Pathogenesis, and Skotomorphogenesis from a Milestone Set of 16,801 Unique Transcripts," Plant Physiology, 139:869-884 (2005).
Qi et al., "RNA processing enables predictable programming of gene expression," Nature Biotechnology, 30:1002-1007 (2012).
Riar et al., "Glyphosate Resistance in a Johnsongrass (*Sorghum halepense*) Biotype from Arkansas," Weed Science, 59:299-304 (2011).
Schönherr et al., "Size selectivity of aqueous pores in astomatous cuticular membranes isolated from Populus canescens (Aiton) Sm. Leaves," Planta, 219:405-411 (2004).
Simeoni et al., "Insight into the mechanism of the peptide-based gene delivery system MPG: implications for delivery of siRNA into mammalian cells," Nucleic Acids Research, 31(11):2717-2724 (2003).
Small, "RNAi for revealing and engineering plant gene functions," Current Opinion in Biotechnology, 18:148-153 (2007).
Swarts et al., "Argonaute of the archaeon *Pyrococcus furiosus* is a DNA-guided nuclease that targets cognate DNA," Nucleic Acid Res., 43(10):5120-5129 (2015).
Swarts et al., "DNA-guided DNA interference by a prokaryotic Argonaute," Nature, 507(7491):258-61 (2014).
Townsend et al., "High frequency modification of plant genes using engineered zinc finger nucleases," Nature, 459:442-445 (2009).
TransIT-TKO® Transfection Reagent, Frequently Asked Questions, Web. 2019.
Van der Meer et al., "Promoted analysis of the chalcone synthase (chs A) gene of Petunia hybrid: a 67 bp promoter region directs flower-specific expression," Plant Mol. Biol., 15:95-109 (1990).
Vila-Aiub et al., "Glyphosate resistance in perennial *Sorghum halepense* (Johnsongrass), endowed by reduced glyphosate translocation and leaf uptake," Pest Manag Sci, 68:430-436 (2012).
Written Opinion dated Mar. 6, 2017, in Singaporean Patent Application No. 2012061529.
Yan et al., Seed Science, China Agriculture Press, pp. 101-103, Tables 2-37 (2001).
Yu et al., "Diversity of Acetyl-Coenzyme A Carboxylase Mutations in Resistant Lolium Populations: Evaluation Using Clethodim," Plant Physiology, 145:547-558 (2007).
Yu et al., "Glyphosate, paraquat and ACCase multiple herbicide resistance evolved in a Lolium rigidum biotype," Planta, 225:499-513 (2007).
Zabkiewicz, "Adjuvants and herbicidal efficacy—present status and future prospects," Weed Research, 40:139-149 (2000).
Zhang, "Artificial trans-acting small interfering RNA: a tool for plant biology study and crop improvements," Planta, 239:1139-1146 (2014).
Zhao et al., "PsOr1, a potential target for RNA interference-based pest management," Insect Molecular Biology, 20(1):97-104 (2011).
Zidack et al., "Promotion of Bacterial Infection of Leaves by an Organosilicone Surfactant: Implications for Biological Weed Control," Biological Control, 2:111-117 (1992).
Zipperian et al., "Silicon Carbide Abrasive Grinding," Quality Matters Newsletter, PACE Technologies 1(2):1-3 (2002).
Andersen et al., "Delivery of siRNA from lyophilized polymeric surfaces," Biomaterials, 29:506-512 (2008).
Baker, "Chlorophyll Fluorescence: A Probe of Photosynthesis In Vivo," Annu. Rev. Plant Biol., 59:89-113 (2008).

Brugiere et al., "Glutamine Synthetase in the Phloem Plays a Major Role in Controlling Proline Production," The Plant Cell, 11:195-2011 (1999).
Chang et al., "Dual-target gene silencing by using long, synthetic siRNA duplexes without triggering antiviral responses," Molecules and Cells, 27(6):689-695 (2009).
Communication pursuant to Article 94(3) EPC dated Mar. 16, 2020, in European Patent Application No. 17194281.6.
Communication pursuant to Article 94(3) EPC dated Mar. 27, 2020, in European Patent Application No. 15811092.4.
Danka et al., "Field Test of Resistance to *Acarapis woodi* (Acari: Tarsonemidae) and of Colony Production by Four Stocks of Honey Bees (Hymenoptera: Apidae)" Journal of Economic Entomology, 88(3):584-591 (1995).
Declaration of Professor Robert James Henry executed Mar. 1, 2018, as filed by Applicant in Australian Patent Application No. 2014262189, pp. 1-119.
Downey et al., "Single and dual parasitic mite infestations on the honey bee, *Apis mellifera* L.," Insectes Sociaux, 47(2):171-176 (2000).
Drobyazko R.V., "Reliable and environmentally friendly insecticide," Protection and quarantine of plants, 2012 (pp. 52, 53) (with English translation).
Extended European Search Report dated Mar. 25, 2020, in European Patent Application No. 19192942.1.
Gilmer et al., "Latent Viruses of Apple I. Detection with Woody Indicators," Plant Pathology, 1(10):1-9 (1971).
Hörmann et al., "Tic32, as Essential Component in Chloroplast Biogenesis," The Journal of Biological Chemistry, 279(33):34756-34762 (2004).
Hwa et al., "Fixation of hybrid vigor in rice: opportunities and challenges," Euphytica, 160:287-293 (2008).
Jasieniuk et al., "Glyphosate-Resistant Italian Ryegrass (*Lolium multiflorum*) in California: Distribution, Response to Glyphosate, and Molecular Evidence for an Altered Target Enzyme," Weed Science, 56(4):496-502 (2008).
Khanbekova et al., The defeat of the honey bee *Apis melifera caucasica* Gorb. By viruses and parasites, and condition of bee colonies in different ecogeographical conditions of Greater Caucasus, Agricultural Biology, p. 43 (2013) (with English translation).
Li et at., "Long dsRNA but not siRNA initiates RNAi in western corn rootworm larvae and adults," Journal of Applied Entomology, 139(6):432-445 (2015).
Nemeth, "Virus, mycoplasma and rickettsia diseases of fruit trees," Martinus Nijhoff Publishers, 197-204 (1986).
N-TER Nanoparticle siRNA, Sigma Aldrich TM website, Web. Nov. 20, 2018 <https://www.sigmaaldrich.com/life-science/custom-oligos/sirna-oligos/n-ter-nanoparticle.html>.
Office Action dated Feb. 20, 2020, in Canadian Patent Application No. 2,905,104.
Office Action dated Feb. 25, 2020, in Japanese Patent Application No. 2017-538699 (with English language translation).
Ossowski et al., "Gene silencing in plants using artificial microRNAs and other small RNAs," The Plant Journal, 53:674-690 (2008).
Partial European Search Report dated Dec. 6, 2019, in European Patent Application No. 19185431.4.
Prado et al., "Design and optimization of degenerated universal primers for the cloning of the plant acetolactate synthase conserved domains," Weed Science, 52:487-491 (2004).
Regalado, "The Next Great GMO Debate," MIT Technology Review, pp. 1-19 (2015) <https://www.technologyreview.com/s/540136/the-next-great-gmo-debate/>.
Sammataro et al., "Some Volatile Plant Oils as Potential Control Agents for *Varroa* Mites (Acari: Varroidae) in Honey Bee Colonies (Hymenoptera: Apidae)," American Bee Journal, 138(9):681-685 (1998).
Subramoni et al., "Lipases as Pathogenicity Factors of Plant Pathogens," Handbook of Hydrocarbon and Lipid Microbiology, 3269-3277 (2010).
Sun, "Characterization of Organosilicone Surfactants and Their Effects on Sulfonylurea Herbicide Activity," Thesis Submitted to the Faculty of the Virginia Polytechnic Institute and State University dated Apr. 5, 1996.

(56) References Cited

OTHER PUBLICATIONS

Tenllado et al., "Crude extracts of bacterially expressed dsRNA can be used to protect plants against virus infections," *BMC Biotechnology*, 3:1-11 (2003).

Tice, "Selecting the right compounds for screening: does Lipinski's Rule of 5 for pharmaceuticals apply to agrochemicals?" *Pest Management Science*, 57(1):3-16 (2001).

TransIT-TKO® Transfection Reagent, Frequently Asked Questions, Web. 2019 <https://www.mirusbio.com/tech-resources/fags/transit-tko-faqs>.

Walton, "Deconstructing the Cell Wall," *Plant Physiol.*, 104:1113-1118 (1994).

Wang et al., "Principle and technology of genetic engineering in plants," in Plant genetic engineering principles and techniques, Beijing: Science Press, pp. 313-315 (1998).

Watson et al., "RNA silencing platforms in plants," *FEBS Letters*, 579:5982-5987 (2005).

Wild Carrot, Noxious Weed Control Board (NWCB) of Washington State (2010) <www.nwcb.wa.gov/detail.asp?weed=46>.

Yibrah et al., "Antisense RNA inhibition of uidA gene expression in transgenic plants: Evidence for interaction between first and second transformation events," *Hereditas*, 118:273-280 (1993).

Zhao et al., "Vegetable Standardized Production Technology," *Hangzhou: Zhejiang Science and Technology Press*, p. 19 (2008).

Burleigh, "Relative quantitative RT-PCR to study the expression of plant nutrient transporters in arbuscular mycorrhizas," *Plant Science* 160: 899-904 (2001).

Gallie et al., "Identification of the motifs within tobacco mosaic virus 5'-leader responsible for enhancing translation," *Nucleic Acids Res.* 20(17):4631-4638 (1992).

Kumar et al., "Sequencing, De Novo Assembly and Annotatlon of the Colorado Potato Beetle, *Liptinotarsa decemlineata*, Transcriptome," *PLoS One*, 9(1):e86012 (2014).

Masoud et al., "Constitutive expression of an inducible β-1,3-glucanase in alfalfa reduces disease severity caused by the comycete pathogen *Phytophthora megasperma* f. sp *medicaginis*, but does not reduce disease severity of chitincontaining fungi," *Transgenic Research*, 5:313-323 (1996).

The Seed Biology Place, Website Gerhard Leubner Lab Royal Holloway, University of London, <http://www.seedbioloy.de/seedtechnology.sap (2012).

* cited by examiner

METHODS AND COMPOSITIONS FOR WEED CONTROL

CROSS-REFERENCE TO RELATED APPLICATIONS

This application is a continuation-in-part of U.S. application Ser. No. 13/612,985 filed on Sep. 13, 2012, which claims the benefit and priority of U.S. Provisional Patent Application No. 61/534,086 filed on Sep. 13, 2011, each of which is herein incorporated by reference in its entirety. The sequence listing that is contained in the file named "P34115US02_Sequence_listing_09282016.txt," which is 807,910 bytes (measured in operating system MS Windows) and was created on Sep. 28, 2016, is filed herewith and incorporated herein by reference.

FIELD

The methods and compositions generally relate to the field of weed management. More specifically, the methods and compositions relate to protoporphyrinogen IX oxidase (PPG oxidase) genes in plants and compositions containing polynucleotide molecules for modulating and/or regulating their expression. Further provided are methods and compositions useful for weed control.

BACKGROUND

Weeds are plants that compete with cultivated plants in an agronomic environment and cost farmers billions of dollars annually in crop losses and the expense of efforts to keep weeds under control. Weeds also serve as hosts for crop diseases and insect pests. The losses caused by weeds in agricultural production environments include decreases in crop yield, reduced crop quality, increased irrigation costs, increased harvesting costs, reduced land value, injury to livestock, and crop damage from insects and diseases harbored by the weeds. The principal means by which weeds cause these effects are: 1) competing with crop plants for water, nutrients, sunlight and other essentials for growth and development, 2) production of toxic or irritant chemicals that cause human or animal health problem, 3) production of immense quantities of seed or vegetative reproductive parts or both that contaminate agricultural products and perpetuate the species in agricultural lands, and 4) production on agricultural and nonagricultural lands of vast amounts of vegetation that must be disposed of Herbicide tolerant weeds are a problem with nearly all herbicides in use, there is a need to effectively manage these weeds. There are over 365 weed biotypes currently identified as being herbicide resistant to one or more herbicides by the Herbicide Resistance Action Committee (HRAC), the North American Herbicide Resistance Action Committee (NAHRAC), and the Weed Science Society of America (WSSA).

BRIEF DESCRIPTION OF THE FIGURES

The following drawings form part of the present specification and are included to further demonstrate certain methods, compositions or results. They may be better understood by reference to one or more of these drawings in combination with the detailed description of specific embodiments presented herein. The invention can be more fully understood from the following description of the figures.

SUMMARY

Figure 1:
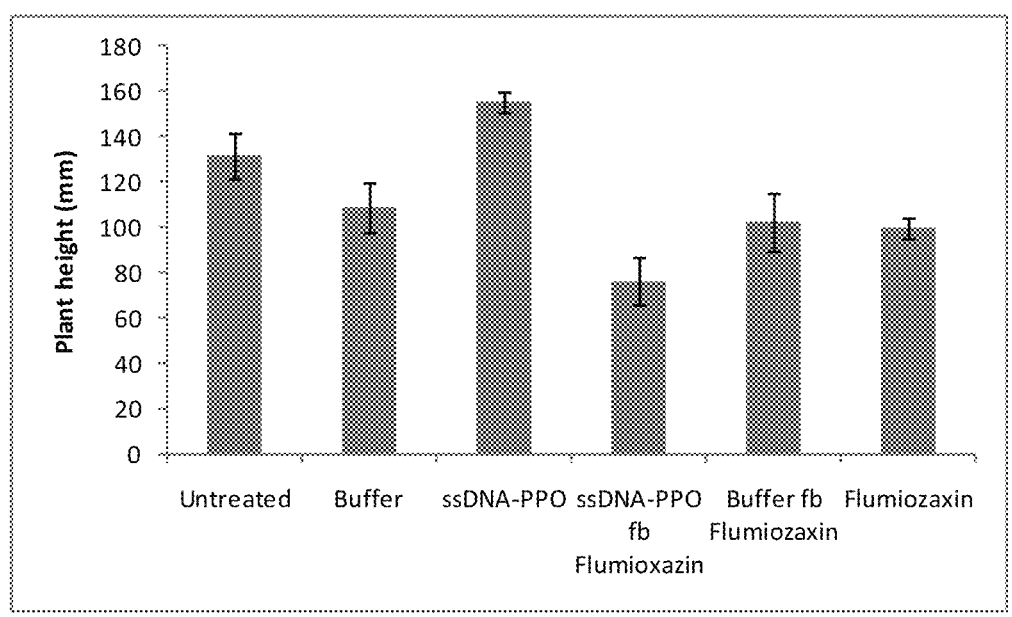
FIG. 1. Treatment of *Amaranthus palmeri* with ssDNA trigger polynucleotides and PPG oxidase inhibitor herbicide, flumioxazin.

In one aspect, the invention provides a method of plant control comprising an external application to a plant of a composition comprising a polynucleotide and a transfer agent, wherein the polynucleotide is essentially identical or essentially complementary to a PPG oxidase gene sequence or fragment thereof, or to the RNA transcript of said PPG oxidase gene sequence or fragment thereof, wherein said PPG oxidase gene sequence is selected from the group consisting of SEQ ID NOs:1-71 and a polynucleotide fragment thereof, whereby the plant growth or development or reproductive ability is reduced or the weedy plant is made more sensitive to a PPG oxidase inhibitor herbicide relative to a plant not treated with said composition. In this manner, plants that have become resistant to the application of PPG oxidase inhibitor containing herbicides may be made more susceptible to the herbicidal effects of a PPG oxidase inhibitor containing herbicide, thus potentiating the effect of the herbicide. The polynucleotide fragment is at least 18 contiguous nucleotides, at least 19 contiguous nucleotides, at least 20 contiguous nucleotides or at least 21 contiguous nucleotides in length and at least 85 percent identical to a PPG oxidase gene sequence selected from the group consisting of SEQ ID NOs:1-71 and the transfer agent is an organosilicone composition or compound. The polynucleotide fragment can also be sense or anti-sense ssDNA or ssRNA, dsRNA or dsDNA, or dsDNA/RNA hybrids. The composition can include more than one polynucleotide fragments, and the composition can include a PPG oxidase inhibitor herbicide and/or other herbicides that enhance the weed control activity of the composition.

In another aspect, polynucleotide molecules and methods for modulating PPG oxidase gene expression in weedy plant species are provided. The method reduces, represses or otherwise delays expression of a PPG oxidase gene in a weedy plant comprising an external application to a weedy plant of a composition comprising a polynucleotide and a transfer agent, wherein the polynucleotide is essentially identical or essentially complementary to a PPG oxidase gene sequence or fragment thereof, or to the RNA transcript of the PPG oxidase gene sequence or fragment thereof, wherein the PPG oxidase gene sequence is selected from the group consisting of SEQ ID NOs:1-71 and a polynucleotide fragment thereof. The polynucleotide fragment is at least 18 contiguous nucleotides, at least 19 contiguous nucleotides, at least 20 contiguous nucleotides, at least 21 contiguous nucleotides in length and at least 85 percent identical to a PPG oxidase gene sequence selected from the group consisting of SEQ ID NOs:1-71 and the transfer agent is an organosilicone compound. The polynucleotide fragment can also be sense or anti-sense ssDNA or ssRNA, dsRNA or dsDNA, or dsDNA/RNA hybrids.

In a further aspect, the polynucleotide molecule containing composition may be combined with other herbicidal compounds to provide additional control of unwanted plants in a field of cultivated plants.

In a further aspect, the polynucleotide molecule composition may be combined with any one or more additional agricultural chemicals, such as insecticides, fungicides, nematocides, bactericides, acaricides, growth regulators, chemosterilants, semiochemicals, repellents, attractants, pheromones, feeding stimulants, biopesticides, microbial pesticides or other biologically active compounds to form a multi-component pesticide giving an even broader spectrum of agricultural protection.

DETAILED DESCRIPTION

Provided are methods and compositions containing a polynucleotide that provide for regulation, repression or delay of PPG oxidase (protoporphyrinogen IX oxidase) gene expression and enhanced control of weedy plant species and importantly PPG oxidase inhibitor resistant weed biotypes. Aspects of the method can be applied to manage various weedy plants in agronomic and other cultivated environments.

The following definitions and methods are provided to better define the present invention and to guide those of ordinary skill in the art in the practice of the present invention. Unless otherwise noted, terms are to be understood according to conventional usage by those of ordinary skill in the relevant art. Where a term is provided in the singular, the inventors also contemplate aspects of the invention described by the plural of that term.

By "non-transcribable" polynucleotides is meant that the polynucleotides do not comprise a complete polymerase II transcription unit.

As used herein "solution" refers to homogeneous mixtures and non-homogeneous mixtures such as suspensions, colloids, micelles, and emulsions.

Weedy plants are plants that compete with cultivated plants, those of particular importance include, but are not limited to, important invasive and noxious weeds and herbicide resistant biotypes in crop production, such as *Amaranthus* species—*A. albus, A. blitoides, A. hybridus, A. palmeri, A. powellii, A. retroflexus, A. spinosus, A. tuberculatus,* and *A. viridis; Ambrosia* species—*A. trifida, A. artemisifolia; Lolium* species—*L. multiflorum, L. rigidium, L perenne; Digitaria* species—*D. insularis; Euphorbia* species—*E. heterophylla; Kochia* species—*K. scoparia; Sorghum* species—*S. halepense; Conyza* species—*C. bonariensis, C. canadensis, C. sumatrensis; Chloris* species—*C. truncate; Echinochloa* species—*E. colona, E. crus-galli; Eleusine* species—*E. indica; Poa* species—*P. annua; Plantago* species—*P. lanceolata; Avena* species—*A. fatua; Chenopodium* species—*C. album; Setaria* species—*S. viridis, Abutilon theophrasti; Ipomoea* species; *Sesbania* species; *Cassia* species; *Sida* species; *Brachiaria* species; and *Solanum* species.

Additional weedy plant species found in cultivated areas include *Alopecurus myosuroides, Avena sterilis, Avena sterilis ludoviciana, Brachiaria plantaginea, Bromus diandrus, Bromus rigidus, Cynosurus echinatus, Digitaria ciliaris, Digitaria ischaemum, Digitaria sanguinalis, Echinochloa oryzicola, Echinochloa phyllopogon, Eriochloa punctata, Hordeum glaucum, Hordeum leporinum, Ischaemum rugosum, Leptochloa chinensis, Lolium persicum, Phalaris minor, Phalaris paradoxa, Rottboellia exalta, Setaria faberi, Setaria viridis* var*, robusta-alba schreiber, Setaria viridis* var*, robusta-purpurea, Snowdenia polystachea, Sorghum sudanese, Alisma plantago-aquatica, Amaranthus lividus, Amaranthus quitensis, Ammania auriculata, Ammania coccinea, Anthemis cotula, Apera spica-venti, Bacopa rotundifolia, Bidens pilosa, Bidens subalternans, Brassica tournefortii, Bromus tectorum, Camelina microcarpa, Chrysanthemum coronarium, Cuscuta campestris, Cyperus difformis, Damasonium minus, Descurainia sophia, Diplotaxis tenuifolia, Echium plantagineum, Elatine triandra* var*, pedicellata, Euphorbia heterophylla, Fallopia convolvulus, Fimbristylis miliacea, Galeopsis tetrahit, Galium spurium, Helianthus annuus, Iva xanthifolia, Ixophorus unisetus, Ipomoea indica, Ipomoea purpurea, Ipomoea sepiaria, Ipomoea aquatic, Ipomoea triloba, Lactuca serriola, Limnocharis flava, Limnophila erecta, Limnophila sessiliflora, Lindernia dubia, Lindernia dubia* var *major, Lindernia micrantha, Lindernia procumbens, Mesembryanthemum crystallinum, Monochoria korsakowii, Monochoria vaginalis, Neslia paniculata, Papaver rhoeas, Parthenium hysterophorus, Pentzia suffruticosa, Phalaris minor, Raphanus raphanistrum, Raphanus sativus, Rapistrum rugosum, Rotala indica* var*, uliginosa, Sagittaria guyanensis, Sagittaria montevidensis, Sagittaria pygmaea, Salsola iberica, Scirpus juncoides* var *ohwianus, Scirpus mucronatus, Setaria lutescens, Sida spinosa, Sinapis arvensis, Sisymbrium orientale, Sisymbrium thellungii, Solanum ptycanthum, Sonchus aspen, Sonchus oleraceus, Sorghum bicolor, Stellaria media, Thlaspi arvense, Xanthium strumarium, Arctotheca calendula, Conyza sumatrensis, Crassocephalum crepidiodes, Cuphea carthagenenis, Epilobium adenocaulon, Erigeron philadelphicus, Landoltia punctata, Lepidium virginicum, Monochoria korsakowii, Solanum americanum, Solanum nigrum, Vulpia bromoides, Youngia japonica, Hydrilla verticillata, Carduus nutans, Carduus pycnocephalus, Centaurea solstitialis, Cirsium arvense, Commelina diffusa, Convolvulus arvensis, Daucus carota, Digitaria ischaemum, Echinochloa crus-pavonis, Fimbristylis miliacea, Galeopsis tetrahit, Galium spurium, Limnophila erecta, Matricaria perforate, Papaver rhoeas, Ranunculus acris, Soliva sessilis, Sphenoclea zeylanica, Stellaria media, Nassella trichotoma, Stipa neesiana, Agrostis stolonifera, Polygonum aviculare, Alopecurus japonicus, Beckmannia syzigachne, Bromus tectorum, Chloris inflate, Echinochloa erecta, Portulaca oleracea,* and *Senecio vulgaris.* It is believed that all plants contain a protoporphyrinogen IX oxidase gene in their genome, the sequence of which can be isolated, and polynucleotides made according to the methods of the present invention that are useful for regulating, suppressing or delaying the expression of the target PPG oxidase gene in the plants and the growth or development of the treated plants.

Some cultivated plants may also be weedy plants when they occur in unwanted environments. Transgenic crops with one or more herbicide tolerances will need specialized methods of management to control weeds and volunteer crop plants and to target the herbicide tolerance transgene as necessary to permit the treated plants to become sensitive to the herbicide.

A "trigger" or "trigger polynucleotide" is a polynucleotide molecule that is homologous or complementary to a target gene polynucleotide. The trigger polynucleotide molecules modulate expression of the target gene when topically applied to a plant surface with a transfer agent, whereby a plant treated with said composition has its growth or development or reproductive ability regulated, suppressed or delayed or said plant is more sensitive to a PPG oxidase inhibitor herbicide or mitosis inhibitor herbicide as a result of said polynucleotide containing composition relative to a plant not treated with a composition containing the trigger molecule. Trigger polynucleotides disclosed herein are generally described in relation to the target gene sequence and may be used in the sense (homologous) or antisense (complementary) orientation as single stranded molecules or comprise both strands as double stranded molecules or nucleotide variants and modified nucleotides thereof depending on the various regions of a gene being targeted.

It is contemplated that the composition of the present invention will contain multiple polynucleotides and herbicides that include but are not limited to PPG oxidase gene trigger polynucleotides and a PPG oxidase inhibitor herbicide and any one or more additional herbicide target gene trigger polynucleotides and the related herbicides and any one or more additional essential gene trigger polynucleotides. Essential genes are genes in a plant that provide key enzymes or other proteins, for example, a biosynthetic enzyme, metabolizing enzyme, receptor, signal transduction protein, structural gene product, transcription factor, or transport protein; or regulating RNAs, such as microRNAs, that are essential to the growth or survival of the organism or cell or involved in the normal growth and development of the plant (Meinke et al., *Trends Plant Sci.*, 2008 September; 13(9):483-91). The suppression of an essential gene enhances the effect of a herbicide that affects the function of a gene product different than the suppressed essential gene. The compositions of the present invention can include various trigger polynucleotides that modulate the expression of an essential gene other than PPG oxidase.

Herbicides for which transgenes for plant tolerance have been demonstrated and the method of the present invention can be applied, include but are not limited to: auxin-like herbicides, glyphosate, glufosinate, sulfonylureas, imidazolinones, bromoxynil, delapon, dicamba, cyclohezanedione, protoporphyrinogen oxidase inhibitors, 4-hydroxyphenyl-pyruvate-dioxygenase inhibitors herbicides. For example, transgenes and their polynucleotide molecules that encode proteins involved in herbicide tolerance are known in the art, and include, but are not limited to a 5-enolpyruvylshikimate-3-phosphate synthase (EPSPS), for example, as more fully described in U.S. Pat. No. 7,807,791 (SEQ ID NO:5); U.S. Pat. Nos. 6,248,876 B1; 5,627,061; 5,804,425; 5,633,435; 5,145,783; 4,971,908; 5,462,910; 5,188,642; 4,940,835; 5,866,775; 6,225,114 B1; 6,130,366; 5,460,667; 4,535,060; 4,769,061; 5,633,448; 5,510,471; Re. 36,449; Re. 37,287 E; and 5,491,288; tolerance to sulfonylurea and/or imidazolinone, for example, as described more fully in U.S. Pat. Nos. 5,605,011; 5,013,659; 5,141,870; 5,767,361; 5,746,180; 5,304,732; 4,761,373; 5,346,107; 5,928,937; and 5,378,824; and international publication WO 96/33270; tolerance to hydroxyphenylpyruvatedioxygenases inhibiting herbicides in plants are described in U.S. Pat. Nos. 6,245,968 B1; 6,268,549; and U.S. Pat. Nos. 6,069,115; 7,462,379 (SEQ ID NO:3); U.S. Pat. Nos. 7,935,869; 7,304,209 (SEQ ID NOs:1, 3, 5 and 15); and US Pat. Pub. 20110191897; aryloxyalkanoate dioxygenase polynucleotides, which confer tolerance to 2,4-D and other phenoxy auxin herbicides as well as to aryloxyphenoxypropionate herbicides as described, for example, in WO2005/107437; U.S. Pat. No. 7,838,733 (SEQ ID NO:5); and dicamba-tolerance polynucleotides as described, for example, in Herman et al. (2005), *J. Biol. Chem.*, 280: 24759-24767. Other examples of herbicide-tolerance traits include those conferred by polynucleotides encoding an exogenous phosphinothricin acetyltransferase, as described in U.S. Pat. Nos. 5,969,213; 5,489,520; 5,550,468; 5,874,265; 5,919,675; 5,561,236; 5,648,477; 5,646,024; 6,177,616; and 5,879,903. Plants containing an exogenous phosphinothricin acetyltransferase can exhibit improved tolerance to glufosinate herbicides, which inhibit the enzyme glutamine synthase. Additionally, herbicide-tolerance polynucleotides include those conferred by polynucleotides conferring altered protoporphyrinogen oxidase (protox) activity, as described in U.S. Pat. Nos. 6,288,306 B1; 6,282,837 B1; and 5,767,373; and WO 01/12825. Plants containing such polynucleotides can exhibit improved tolerance to any of a variety of herbicides which target the protox enzyme (also referred to as protox inhibitors). Polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase described in U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al. (1993), *Plant J.*, 4:833-840, and Misawa et al. (1994), *Plant J.*, 6:481-489, for norflurazon tolerance; a polynucleotide molecule encoding acetohydroxyacid synthase (AHAS, aka ALS) described in Sathasiivan et al. (1990), *Nucl. Acids Res.*, 18:468-2193, for tolerance to sulfonylurea herbicides; and the bar gene described in DeBlock et al. (1987), *EMBO J.*, 6:2513-2519, for glufosinate and bialaphos tolerance. The transgenic coding regions and regulatory elements of the herbicide tolerance genes are targets in which polynucleotide triggers and herbicides can be included in the composition of the present invention.

The composition includes a component that is a PPG oxidase inhibitor herbicide, which includes but is not limited to acifluorfen-Na, bifenox, chlomethoxyfen, fluoroglycofen-ethyl, fomesafen, halosafen, lactofen, oxyfluorfen, fluazolate, pyraflufen-ethyl, cinidon-ethyl, flumioxazin, flumiclorac-pentyl, fluthiacet-methyl, thidiazimin, oxadiazon, oxadiargyl, azafenidin, carfentrazone-ethyl, sulfentrazone, pentoxazone, benzfendizone, butafenacil, pyrazogyl, and profluazol.

Numerous additional herbicides with similar or different modes of action (herein referred to as co-herbicides) are available that can be added to the composition, for example, members of the herbicide families that include but are not limited to amide herbicides, aromatic acid herbicides, arsenical herbicides, benzothiazole herbicides, benzoylcyclohexanedione herbicides, benzofuranyl alkylsulfonate herbicides, carbamate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides. In particular, the rates of use of the added herbicides can be reduced in compositions comprising the polynucleotides. Contemplated use rate reductions of the additional added herbicides can be 10-25 percent, 26-50 percent, 51-75 percent or more, and can be achieved from the enhanced activity of the polynucleotides and herbicide composition.

Representative co-herbicides of the families include but are not limited to acetochlor, acifluorfen, acifluorfen-sodium, aclonifen, acrolein, alachlor, alloxydim, allyl alcohol, ametryn, amicarbazone, amidosulfuron, aminopyralid, amitrole, ammonium sulfamate, anilofos, asulam, atraton, atrazine, azimsulfuron, BCPC, beflubutamid, benazolin, benfluralin, benfuresate, bensulfuron, bensulfuron-methyl, bensulide, bentazone, benzfendizone, benzobicyclon, benzofenap, bifenox, bilanafos, bispyribac, bispyribac-sodium, borax, bromacil, bromobutide, bromoxynil, butachlor, butafenacil, butamifos, butralin, butroxydim, butylate, cacodylic acid, calcium chlorate, cafenstrole, carbetamide, carfentrazone, carfentrazone-ethyl, CDEA, CEPC, chlorflurenol, chlorflurenol-methyl, chloridazon, chlorimuron, chlorimuron-ethyl, chloroacetic acid, chlorotoluron, chlorpropham, chlorsulfuron, chlorthal, chlorthal-dimethyl, cinidon-ethyl, cinmethylin, cinosulfuron, cisanilide, clethodim, clodinafop, clodinafop-propargyl, clomazone, clomeprop, clopyralid, cloransulam, cloransulam-methyl, CMA, 4-CPB, CPMF, 4-CPP, CPPC, cresol, cumyluron, cyanamide, cyanazine, cycloate, cyclosulfamuron, cycloxydim, cyhalofop, cyhalofop-butyl, 2,4-D, 3,4-DA, daimuron, dalapon, dazomet, 2,4-DB, 3,4-DB, 2,4-DEB, desmedipham, dicamba, dichlobenil, ortho-dichlorobenzene, para-dichlorobenzene, dichlorprop, dichlorprop-P, diclofop, diclofop-methyl, diclosulam, difenzoquat, difenzoquat metilsulfate, diflufenican, diflufenzopyr, dimefuron, dimepiperate, dimethachlor, dimethametryn, dimethenamid, dimethenamid-P, dimethipin, dimethylarsinic acid, dinitramine, dinoterb, diphenamid, diquat, diquat dibromide, dithiopyr, diuron, DNOC, 3,4-DP, DSMA, EBEP, endothal, EPTC, esprocarb, ethalfluralin, ethametsulfuron, ethametsulfuron-methyl, ethofumesate, ethoxyfen, ethoxysulfuron, etobenzanid, fenoxaprop-P, fenoxaprop-P-ethyl, fentrazamide, ferrous sulfate, flamprop-M, flazasulfuron, florasulam, fluazifop, fluazifop-butyl, fluazifop-P, fluazifop-P-butyl, flucarbazone, flucarbazone-sodium, flucetosulfuron, fluchloralin, flufenacet, flufenpyr, flufenpyr-ethyl, flumetsulam, flumiclorac, flumiclorac-pentyl, flumioxazin, fluometuron, fluoroglycofen, fluoroglycofen-ethyl, flupropanate, flupyrsulfuron, flupyrsulfuron-methyl-sodium, flurenol, fluridone, fluorochloridone, fluoroxypyr, flurtamone, fluthiacet, fluthiacet-methyl, fomesafen, foramsulfuron, fosamine, glufosinate, glufosinate-ammonium, glyphosate, halosulfuron, halosulfuron-methyl, haloxyfop, haloxyfop-P, HC-252, hexazinone, imazamethabenz, imazamethabenz-methyl, imazamox, imazapic, imazapyr, imazaquin, imazethapyr, imazosulfuron, indanofan, iodomethane, iodosulfuron, iodosulfuron-methyl-sodium, ioxynil, isoproturon, isouron, isoxaben, isoxachlortole, isoxaflutole, karbutilate, lactofen, lenacil, linuron, MAA, MAMA, MCPA, MCPA-thioethyl, MCPB, mecoprop, mecoprop-P, mefenacet, mefluidide, mesosulfuron, mesosulfuron-methyl, mesotrione, metam, metamifop, metamitron, metazachlor, methabenzthiazuron, methylarsonic acid, methyldymron, methyl isothiocyanate, metobenzuron, metolachlor, S-metolachlor, metosulam, metoxuron, metribuzin, metsulfuron, metsulfuron-methyl, MK-66, molinate, monolinuron, MSMA, naproanilide, napropamide, naptalam, neburon, nicosulfuron, nonanoic acid, norflurazon, oleic acid (fatty acids), orbencarb, orthosulfamuron, oryzalin, oxadiargyl, oxadiazon, oxasulfuron, oxaziclomefone, oxyfluorfen, paraquat, paraquat dichloride, pebulate, pendimethalin, penoxsulam, pentachlorophenol, pentanochlor, pentoxazone, pethoxamid, petrolium oils, phenmedipham, phenmedipham-ethyl, picloram, picolinafen, pinoxaden, piperophos, potassium arsenite, potassium azide, pretilachlor, primisulfuron, primisulfuron-methyl, prodiamine, profluazol, profoxydim, prometon, prometryn, propachlor, propanil, propaquizafop, propazine, propham, propisochlor, propoxycarbazone, propoxycarbazone-sodium, propyzamide, prosulfocarb, prosulfuron, pyraclonil, pyraflufen, pyraflufen-ethyl, pyrazolynate, pyrazosulfuron, pyrazosulfuron-ethyl, pyrazoxyfen, pyribenzoxim, pyributicarb, pyridafol, pyridate, pyriftalid, pyriminobac, pyriminobac-methyl, pyrimisulfan, pyrithiobac, pyrithiobac-sodium, quinclorac, quinmerac, quinoclamine, quizalofop, quizalofop-P, rimsulfuron, sethoxydim, siduron, simazine, simetryn, SMA, sodium arsenite, sodium azide, sodium chlorate, sulcotrione, sulfentrazone, sulfometuron, sulfometuron-methyl, sulfosate, sulfosulfuron, sulfuric acid, tar oils, 2,3,6-TBA, TCA, TCA-sodium, tebuthiuron, tepraloxydim, terbacil, terbumeton, terbuthylazine, terbutryn, thenylchlor, thiazopyr, thifensulfuron, thifensulfuron-methyl, thiobencarb, tiocarbazil, topramezone, tralkoxydim, tri-allate, triasulfuron, triaziflam, tribenuron, tribenuron-methyl, tricamba, triclopyr, trietazine, trifloxysulfuron, trifloxysulfuron-sodium, trifluralin, triflusulfuron, triflusulfuron-methyl, trihydroxytriazine, tritosulfuron, [3-[2-chloro-4-fluoro-5-(methyl-6-trifluoromethyl-2,4-dioxo-2,3,4-tetrahydropyrimidin-3-yl)phenoxy]-2-pyridyloxy]acetic acid ethyl ester (CAS RN 353292-3-6), 4-[(4,5-dihydro-3-methoxy-4-methyl-5-oxo)-H-,2,4-triazolylcarbonyl-sulfamoyl]-5-methylthiophene-3-carboxylic acid (BAY636), BAY747 (CAS RN 33504-84-2), topramezone (CAS RN 2063-68-8), 4-hydroxy-3-[[2-[(2-methoxyethoxy)methyl]-6-(trifluoro-methyl)-3-pyridinyl]carbonyl]-bicyclo[3.2.]oct-3-en-2-one (CAS RN 35200-68-5), and 4-hydroxy-3-[[2-(3-methoxypropyl)-6-(difluoromethyl)-3-pyridinyl]carbonyl]-bicyclo[3.2.]oct-3-en-2-one. Additionally, including herbicidal compounds of unspecified modes of action as described in CN101279950A, CN101279951A, DE10000600A1, DE10116399A1, DE102004054666A1, DE102005014638A1, DE102005014906A1, DE102007012168A1, DE102010042866A1, DE10204951A1, DE10234875A1, DE10234876A1, DE10256353A1, DE10256354A1, DE10256367A1, EP1157991A2, EP1238586A1, EP2147919A1, EP2160098A2, JP03968012B2, JP2001253874A, JP2002080454A, JP2002138075A, JP2002145707A, JP2002220389A, JP2003064059A, JP2003096059A, JP2004051628A, JP2004107228A, JP2005008583A, JP2005239675A, JP2005314407A, JP2006232824A, JP2006282552A, JP2007153847A, JP2007161701A, JP2007182404A, JP2008074840A, JP2008074841A, JP2008133207A, JP2008133218A, JP2008169121A, JP2009067739A, JP2009114128A, JP2009126792A, JP2009137851A, US20060111241A1, US20090036311A1, US20090054240A1, US20090215628A1, US20100099561A1, US20100152443A1, US20110105329A1, US20110201501A1, WO2001055066A2, WO2001056975A1, WO2001056979A1, WO2001090071A2, WO2001090080A1, WO2002002540A1, WO2002028182A1, WO2002040473A1, WO2002044173A2, WO2003000679A2, WO2003006422A1, WO2003013247A1, WO2003016308A1, WO2003020704A1, WO2003022051A1, WO2003022831A1, WO2003022843A1, WO2003029243A2, WO2003037085A1, WO2003037878A1, WO2003045878A2, WO2003050087A2, WO2003051823A1, WO2003051824A1, WO2003051846A2, WO2003076409A1, WO2003087067A1, WO2003090539A1, WO2003091217A1,
WO2003104206A2,
WO2004002981A2,
WO2004029060A1,
WO2004035563A1,
WO2004037787A1,
WO2004067527A1,
WO2005000824A1,
WO2005040152A1,
WO2005047281A1,
WO2005061464A1,
WO2005070889A1,
WO2005095335A1,
WO2006024820A1,
WO2006029829A1,
WO2006050803A1,
WO2006123088A2,
WO2006125688A1,
WO2007026834A1,
WO2007077201A1,
WO2007096576A1,
WO2007134984A1,
WO2008029084A1,
WO2008071918A1,
WO2008084073A1,
WO2008102908A1,
WO2008152073A2,
WO2009005297A2,
WO2009063180A1,
WO2009068171A2,
WO2009090401A2,
WO2009115788A1,
WO2009152995A1,
WO2010012649A1,
WO2010026989A1,
WO2010049270A1,
WO2010049405A1,
WO2010063422A1,
WO2010078906A2,
WO2010104217A1,
WO2010112826A3,
WO2010119906A1,
WO2011003776A2,
WO2011065451A1, all of which are incorporated herein by reference.

WO2003093269A2,
WO2004002947A1,
WO2004011429A1,
WO2004035545A2,
WO2004035564A1,
WO2004067518A1,
WO2004077950A1,
WO2005007627A1,
WO2005047233A1,
WO2005061443A2,
WO2005068434A1,
WO2005089551A1,
WO2006006569A1,
WO2006029828A1,
WO2006037945A1,
WO2006090792A1,
WO2006125687A1,
WO2007003294A1,
WO2007071900A1,
WO2007077247A1,
WO2007119434A1,
WO2008009908A1,
WO2008059948A1,
WO2008074991A1,
WO2008100426A2,
WO2008152072A2,
WO2009000757A1,
WO2009035150A2,
WO2009068170A2,
WO2009086041A1,
WO2009090402A2,
WO2009116558A1,
WO2009158258A1,
WO2010012649A1,
WO2010034153A1,
WO2010049369A1,
WO2010049414A1,
WO2010069802A1,
WO2010078912A1,
WO2010108611A1,
WO2010116122A3,
WO2010130970A1,
WO2011035874A1,

An agronomic field in need of plant control is treated by application of the composition directly to the surface of the growing plants, such as by a spray. For example, the method is applied to control weeds in a field of crop plants by spraying the field with the composition. The composition can be provided as a tank mix, a sequential treatment of components (generally the polynucleotide containing composition followed by the herbicide), or a simultaneous treatment or mixing of one or more of the components of the composition from separate containers. Treatment of the field can occur as often as needed to provide weed control and the components of the composition can be adjusted to target specific weed species or weed families through utilization of specific polynucleotides or polynucleotide compositions capable of selectively targeting the specific species or plant family to be controlled. The composition can be applied at effective use rates according to the time of application to the field, for example, preplant, at planting, post planting, post harvest. PPG oxidase inhibitor herbicides can be applied to a field at rates of 100 to 500 g ai/ha (active ingredient per hectare) or more. The polynucleotides of the composition can be applied at rates of 1 to 30 grams per acre depending on the number of trigger molecules needed for the scope of weeds in the field.

Crop plants in which weed control is needed include, but are not limited to, i) corn, soybean, cotton, canola, sugar beet, alfalfa, sugarcane, rice, and wheat; ii) vegetable plants including, but not limited to, tomato, sweet pepper, hot pepper, melon, watermelon, cucumber, eggplant, cauliflower, broccoli, lettuce, spinach, onion, peas, carrots, sweet corn, Chinese cabbage, leek, fennel, pumpkin, squash or gourd, radish, Brussels sprouts, tomatillo, garden beans, dry beans, or okra; iii) culinary plants including, but not limited to, basil, parsley, coffee, or tea; iv) fruit plants including, but not limited to, apple, pear, cherry, peach, plum, apricot, banana, plantain, table grape, wine grape, citrus, avocado, mango, or berry; v) a tree grown for ornamental or commercial use, including, but not limited to, a fruit or nut tree; or vi) an ornamental plant (e.g., an ornamental flowering plant or shrub or turf grass). The methods and compositions provided herein can also be applied to plants produced by a cutting, cloning, or grafting process (i.e., a plant not grown from a seed) including fruit trees and plants that include, but are not limited to, citrus, apples, avocados, tomatoes, eggplant, cucumber, melons, watermelons, and grapes, as well as various ornamental plants.

Pesticidal Mixtures

The polynucleotide compositions may also be used as mixtures with various agricultural chemicals and/or insecticides, miticides and fungicides, pesticidal and biopesticidal agents. Examples include but are not limited to azinphosmethyl, acephate, isoxathion, isofenphos, ethion, etrimfos, oxydemeton-methyl, oxydeprofos, quinalphos, chlorpyrifos, chlorpyrifos-methyl, chlorfenvinphos, cyanophos, dioxabenzofos, dichlorvos, disulfoton, dimethylvinphos, dimethoate, sulprofos, diazinon, thiometon, tetrachlorvinphos, temephos, tebupirimfos, terbufos, naled, vamidothion, pyraclofos, pyridafenthion, pirimiphos-methyl, fenitrothion, fenthion, phenthoate, flupyrazophos, prothiofos, propaphos, profenofos, phoxime, phosalone, phosmet, formothion, phorate, malathion, mecarbam, mesulfenfos, methamidophos, methidathion, parathion, methyl parathion, monocrotophos, trichlorphon, EPN, isazophos, isamidofos, cadusafos, diamidaphos, dichlofenthion, thionazin, fenamiphos, fosthiazate, fosthietan, phosphocarb, DSP, ethoprophos, alanycarb, aldicarb, isoprocarb, ethiofencarb, carbaryl, carbosulfan, xylylcarb, thiodicarb, pirimicarb, fenobucarb, furathiocarb, propoxur, bendiocarb, benfuracarb, methomyl, metolcarb, XMC, carbofuran, aldoxycarb, oxamyl, acrinathrin, allethrin, esfenvalerate, empenthrin, cycloprothrin, cyhalothrin, gamma-cyhalothrin, lambda-cyhalothrin, cyfluthrin, beta-cyfluthrin, cypermethrin, alpha-cypermethrin, zeta-cypermethrin, silafluofen, tetramethrin, tefluthrin, deltamethrin, tralomethrin, bifenthrin, phenothrin, fenvalerate, fenpropathrin, furamethrin, prallethrin, flucythrinate, fluvalinate, flubrocythrinate, permethrin, resmethrin, ethofenprox, cartap, thiocyclam, bensultap, acetamiprid, imidacloprid, clothianidin, dinotefuran, thiacloprid, thiamethoxam, nitenpyram, chlorfluazuron, diflubenzuron, teflubenzuron, triflumuron, novaluron, noviflumuron, bistrifluoron, fluazuron, flucycloxuron, flufenoxuron, hexaflumuron, lufenuron, chromafenozide, tebufenozide, halofenozide, methoxyfenozide, diofenolan, cyromazine, pyriproxyfen, buprofezin, methoprene, hydroprene, kinoprene, triazamate, endosulfan, chlorfenson, chlorobenzilate, dicofol, bromopropylate, acetoprole, fipronil, ethiprole, pyrethrin, rotenone, nicotine sulphate, BT (*Bacillus Thuringiensis*) agent, spinosad, abamectin, acequinocyl, amidoflumet, amitraz, etoxazole, chinomethionat, clofentezine, fenbutatin oxide, dienochlor, cyhexatin, spirodiclofen, spiromesifen, tetradifon, tebufenpyrad, binapacryl, bifenazate, pyridaben, pyrimidifen, fenazaquin, fenothiocarb, fenpyroximate, fluacrypyrim, fluazinam, flufenzin, hexythiazox, propargite, benzomate, polynactin complex, milbemectin, lufenuron, mecarbam, methiocarb, mevinphos, halfenprox, azadirachtin, diafenthiuron, indoxacarb, emamectin benzoate, potassium oleate, sodium oleate, chlorfenapyr, tolfenpyrad, pymetrozine, fenoxycarb, hydramethylnon, hydroxy propyl starch, pyridalyl, flufenerim, flubendiamide, flonicamid, metaflumizole, lepimectin, TPIC, albendazole, oxibendazole, oxfendazole, trichlamide, fensulfothion, fenbendazole, levamisole hydrochloride, morantel tartrate, dazomet, metam-sodium, triadimefon, hexaconazole, propiconazole, ipconazole, prochloraz, triflumizole, tebuconazole, epoxiconazole, difenoconazole, flusilazole, triadimenol, cyproconazole, metconazole, fluquinconazole, bitertanol, tetraconazole, triticonazole, flutriafol, penconazole, diniconazole, fenbuconazole, bromuconazole, imibenconazole, simeconazole, myclobutanil, hymexazole, imazalil, furametpyr, thifluzamide, etridiazole, oxpoconazole, oxpoconazole fumarate, pefurazoate, prothioconazole, pyrifenox, fenarimol, nuarimol, bupirimate, mepanipyrim, cyprodinil, pyrimethanil, metalaxyl, mefenoxam, oxadixyl, benalaxyl, thiophanate, thiophanate-methyl, benomyl, carbendazim, fuberidazole, thiabendazole, manzeb, propineb, zineb, metiram, maneb, ziram, thiuram, chlorothalonil, ethaboxam, oxycarboxin, carboxin, flutolanil, silthiofam, mepronil, dimethomorph, fenpropidin, fenpropimorph, spiroxamine, tridemorph, dodemorph, flumorph, azoxystrobin, kresoxim-methyl, metominostrobin, orysastrobin, fluoxastrobin, trifloxystrobin, dimoxystrobin, pyraclostrobin, picoxystrobin, iprodione, procymidone, vinclozolin, chlozolinate, flusulfamide, dazomet, methyl isothiocyanate, chloropicrin, methasulfocarb, hydroxyisoxazole, potassium hydroxyisoxazole, echlomezol, D-D, carbam, basic copper chloride, basic copper sulfate, copper nonylphenolsulfonate, oxine copper, DBEDC, anhydrous copper sulfate, copper sulfate pentahydrate, cupric hydroxide, inorganic sulfur, wettable sulfur, lime sulfur, zinc sulfate, fentin, sodium hydrogen carbonate, potassium hydrogen carbonate, sodium hypochlorite, silver, edifenphos, tolclofos-methyl, fosetyl, iprobenfos, dinocap, pyrazophos, carpropamid, fthalide, tricyclazole, pyroquilon, diclocymet, fenoxanil, kasugamycin, validamycin, polyoxins, blasticiden S, oxytetracycline, mildiomycin, streptomycin, rape seed oil, machine oil, benthiavalicarbisopropyl, iprovalicarb, propamocarb, diethofencarb, fluoroimide, fludioxanil, fenpiclonil, quinoxyfen, oxolinic acid, chlorothalonil, captan, folpet, probenazole, acibenzolar-S-methyl, tiadinil, cyflufenamid, fenhexamid, diflumetorim, metrafenone, picobenzamide, proquinazid, famoxadone, cyazofamid, fenamidone, zoxamide, boscalid, cymoxanil, dithianon, fluazinam, dichlofluanide, triforine, isoprothiolane, ferimzone, diclomezine, tecloftalam, pencycuron, chinomethionat, iminoctadine acetate, iminoctadine albesilate, ambam, polycarbamate, thiadiazine, chloroneb, nickel dimethyldithiocarbamate, guazatine, dodecylguanidine-acetate, quintozene, tolylfluanid, anilazine, nitrothalisopropyl, fenitropan, dimethirimol, benthiazole, harpin protein, flumetover, mandipropamide and penthiopyrad.

Polynucleotides

As used herein, the terms "DNA," "DNA molecule," and "DNA polynucleotide molecule" refer to a single-stranded DNA (ssDNA) or double-stranded DNA (dsDNA) molecule of genomic or synthetic origin, such as a polymer of deoxyribonucleotide bases or a DNA polynucleotide molecule. As used herein, the terms "DNA sequence," "DNA nucleotide sequence" or "DNA polynucleotide sequence" refer to the nucleotide sequence of a DNA molecule. As used herein, the terms "RNA," "RNA molecule," "RNA polynucleotide molecule" refer to a single-stranded RNA (ssRNA) or double-stranded RNA (dsRNA) molecule of genomic or synthetic origin, such as a polymer of ribonucleotide bases that comprise single or double stranded regions. Unless otherwise stated, nucleotide sequences in the text of this specification are given, when read from left to right, in the 5' to 3' direction. The nomenclature used herein is that required by Title 37 of the United States Code of Federal Regulations § 1.822 and set forth in the tables in WIPO Standard ST.25 (1998), Appendix 2, Tables 1 and 3.

As used herein, "polynucleotide" refers to a DNA or RNA molecule containing multiple nucleotides and generally refers both to "oligonucleotides" (a polynucleotide molecule of typically 50 or fewer nucleotides in length) and polynucleotides of 51 or more nucleotides. Embodiments include compositions including oligonucleotides having a length of 18-25 nucleotides (18-mers, 19-mers, 20-mers, 21-mers, 22-mers, 23-mers, 24-mers, or 25-mers), for example, oligonucleotides of Table 3 (SEQ ID NOs:1382-2221) or fragments thereof or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), for example, oligonucleotides of Table 2 (SEQ ID NOs:72-1381) or fragments thereof or long polynucleotides having a length greater than about 300 nucleotides (for example, polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example, up to the entire length of a target gene including coding or non-coding or both coding and non-coding portions of the target gene), for example, polynucleotides of Table 1 (SEQ ID NOs:1-71), wherein the selected polynucleotides or fragments thereof homologous or complementary to SEQ ID NOs:1-71 suppresses, represses or otherwise delay the expression of the target PPG oxidase gene. A target gene comprises any polynucleotide molecule in a plant cell or fragment thereof for which the modulation of the expression of the target gene is provided by the methods and compositions. Where a polynucleotide is double-stranded, its length can be similarly described in terms of base pairs. Oligonucleotides and polynucleotides can be made that are essentially identical or essentially complementary to adjacent genetic elements of a gene, for example, spanning the junction region of an intron and exon, the junction region of a promoter and a transcribed region, the junction region of a 5' leader and a coding sequence, the junction of a 3' untranslated region and a coding sequence.

Polynucleotide compositions used in the various embodiments include compositions including oligonucleotides or polynucleotides or a mixture of both, including RNA or DNA or RNA/DNA hybrids or chemically modified oligonucleotides or polynucleotides or a mixture thereof. In some embodiments, the polynucleotide may be a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In some embodiments, the polynucleotide includes non-canonical nucleotides such as inosine, thiouridine, or pseudouridine. In some embodiments, the polynucleotide includes chemically modified nucleotides. Examples of chemically modified oligonucleotides or polynucleotides are well known in the art; see, for example, US Patent Publication 20110171287, US Patent Publication 20110171176, US Patent Publication 20110152353, US Patent Publication, 20110152346, and US Patent Publication 20110160082, each of which is herein incorporated by reference in its entirety. For example, including but not limited to the naturally occurring phosphodiester backbone of an oligonucleotide or polynucleotide can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (for example, fluorescein or rhodamine) or other label (for example, biotin).

The polynucleotides can be single- or double-stranded RNA or single- or double-stranded DNA or double-stranded DNA/RNA hybrids or modified analogues thereof, and can be of oligonucleotide lengths or longer. In more specific embodiments the polynucleotides that provide single-stranded RNA in the plant cell are selected from the group consisting of (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, and (i) a double-stranded, hybridized RNA/DNA molecule, or combinations thereof. In some embodiments, these polynucleotides include chemically modified nucleotides or non-canonical nucleotides. In some embodiments, the oligonucleotides may be blunt-ended or may comprise a 3' overhang of from 1-5 nucleotides of at least one or both of the strands. Other configurations of the oligonucleotide are known in the field and are contemplated herein. In embodiments of the method, the polynucleotides include double-stranded DNA formed by intramolecular hybridization, double-stranded DNA formed by intermolecular hybridization, double-stranded RNA formed by intramolecular hybridization, or double-stranded RNA formed by intermolecular hybridization. In one embodiment, the polynucleotides include single-stranded DNA or single-stranded RNA that self-hybridizes to form a hairpin structure having at least partially double-stranded structure including at least one segment that will hybridize to RNA transcribed from the gene targeted for suppression. Not intending to be bound by any mechanism, it is believed that such polynucleotides are or will produce single-stranded RNA with at least one segment that will hybridize to RNA transcribed from the gene targeted for suppression. In certain other embodiments, the polynucleotides further include a promoter, generally a promoter functional in a plant, for example, a pol II promoter, a pol III promoter, a pol IV promoter, or a pol V promoter.

The term "gene" refers to components that comprise chromosomal DNA, plasmid DNA, cDNA, intron and exon DNA, artificial DNA polynucleotide, or other DNA that encodes a peptide, polypeptide, protein, or RNA transcript molecule, and the genetic elements flanking the coding sequence that are involved in the regulation of expression, such as promoter regions, 5' leader regions, 3' untranslated region that may exist as native genes or transgenes in a plant genome. The gene or a fragment thereof is isolated and subjected to polynucleotide sequencing methods that determines the order of the nucleotides that comprise the gene. Any of the components of the gene are potential targets for a trigger oligonucleotide and polynucleotides.

The trigger polynucleotide molecules are designed to modulate expression by inducing regulation or suppression of an endogenous PPG oxidase gene in a plant and are designed to have a nucleotide sequence essentially identical or essentially complementary to the nucleotide sequence of an endogenous PPG oxidase gene of a plant or to the sequence of RNA transcribed from an endogenous PPG oxidase gene of a plant, including a transgene in a plant that provides for a herbicide resistant PPG oxidase enzyme, which can be a coding sequence or a non-coding sequence. Effective molecules that modulate expression are referred to as "a trigger molecule, or trigger polynucleotides." By "essentially identical" or "essentially complementary" is meant that the trigger polynucleotides (or at least one strand of a double-stranded polynucleotide or portion thereof, or a portion of a single strand polynucleotide) are designed to hybridize to the endogenous gene noncoding sequence or to RNA transcribed (known as messenger RNA or an RNA transcript) from the endogenous gene to effect regulation or suppression of expression of the endogenous gene. Trigger molecules are identified by "tiling" the gene targets with partially overlapping probes or non-overlapping probes of antisense or sense polynucleotides that are essentially identical or essentially complementary to the nucleotide sequence of an endogenous gene. Multiple target sequences can be aligned and sequence regions with homology in common, according to the methods, are identified as potential trigger molecules for the multiple targets. Multiple trigger molecules of various lengths, for example 18-25 nucleotides, 26-50 nucleotides, 51-100 nucleotides, 101-200 nucleotides, 201-300 nucleotides or more can be pooled into a few treatments in order to investigate polynucleotide molecules that cover a portion of a gene sequence (for example, a portion of a coding versus a portion of a noncoding region, or a 5' versus a 3' portion of a gene) or an entire gene sequence including coding and noncoding regions of a target gene. Polynucleotide molecules of the pooled trigger molecules can be divided into smaller pools or single molecules in order to identify trigger molecules that provide the desired effect.

The target gene RNA and DNA polynucleotide molecules (Table 1, SEQ ID NOs:1-71) are sequenced by any number of available methods and equipment. Some of the sequencing technologies are available commercially, such as the sequencing-by-hybridization platform from Affymetrix Inc. (Sunnyvale, Calif.) and the sequencing-by-synthesis platforms from 454 Life Sciences (Bradford, Conn.), Illumina/ Solexa (Hayward, Calif.) and Helicos Biosciences (Cambridge, Mass.), and the sequencing-by-ligation platform from Applied Biosystems (Foster City, Calif.), as described below. In addition to the single molecule sequencing performed using sequencing-by-synthesis of Helicos Biosciences, other single molecule sequencing technologies are encompassed by the method and include the SMRT™ technology of Pacific Biosciences, the Ion Torrent™ technology, and nanopore sequencing being developed for example, by Oxford Nanopore Technologies. A PPG oxidase target gene comprising DNA or RNA can be isolated using primers or probes essentially complementary or essentially homologous to SEQ ID NOs:1-71 or a fragment thereof. A polymerase chain reaction (PCR) gene fragment can be produced using primers essentially complementary or essentially homologous to SEQ IDs NO:1-71 or a fragment thereof that is useful to isolate a PPG oxidase gene from a plant genome. SEQ ID NOs: 1-71 or fragments thereof can be used in various sequence capture technologies to isolate additional target gene sequences, for example, including but not limited to Roche NimbleGen® (Madison, Wis.) and Streptavidin-coupled Dynabeads® (Life Technologies, Grand Island, N.Y.) and US Patent Publication 20110015284, herein incorporated by reference in its entirety.

Embodiments of functional single-stranded polynucleotides have sequence complementarity that need not be 100 percent, but is at least sufficient to permit hybridization to RNA transcribed from the target gene or DNA of the target gene to form a duplex to permit a gene silencing mechanism. Thus, in embodiments, a polynucleotide fragment is designed to be essentially identical to, or essentially complementary to, a sequence of 18 or more contiguous nucleotides in either the target PPG oxidase gene sequence or messenger RNA transcribed from the target gene. By "essentially identical" is meant having 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the target gene or RNA transcribed from the target gene; by "essentially complementary" is meant having 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene. In some embodiments, polynucleotide molecules are designed to have 100 percent sequence identity with or complementarity to one allele or one family member of a given target gene (coding or non-coding sequence of a gene); in other embodiments, the polynucleotide molecules are designed to have 100 percent sequence identity with or complementarity to multiple alleles or family members of a given target gene. The trigger polynucleotide sequences in the sequence listing SEQ ID NOs: 1-2221 or table 1, 2 or 3 may be complementary or homologous to a portion of the PPG oxidase target gene sequence.

In certain embodiments, the polynucleotides used in the compositions that are essentially identical or essentially complementary to the target gene or transcript will comprise the predominant nucleic acid in the composition. Thus in certain embodiments, the polynucleotides that are essentially identical or essentially complementary to the target gene or transcript will comprise at least about 50%, 75%, 95%, 98% or 100% of the nucleic acids provided in the composition by either mass or molar concentration. However, in certain embodiments, the polynucleotides that are essentially identical or essentially complementary to the target gene or transcript can comprise at least about 1% to about 50%, about 10% to about 50%, about 20% to about 50%, or about 30% to about 50% of the nucleic acids provided in the composition by either mass or molar concentration. Also provided are compositions where the polynucleotides that are essentially identical or essentially complementary to the target gene or transcript can comprise at least about 1% to 100%, about 10% to 100%, about 20% to about 100%, about 30% to about 50%, or about 50% to a 100% of the nucleic acids provided in the composition by either mass or molar concentration.

"Identity" refers to the degree of similarity between two polynucleic acid or protein sequences. An alignment of the two sequences is performed by a suitable computer program. A widely used and accepted computer program for performing sequence alignments is CLUSTALW v1.6 (Thompson et al., *Nucl. Acids Res.*, 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between a 200 and a 400 amino acid protein, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Trigger molecules for specific gene family members can be identified from coding and/or non-coding sequences of gene families of a plant or multiple plants, by aligning and selecting 200-300 polynucleotide fragments from the least homologous regions amongst the aligned sequences and evaluated using topically applied polynucleotides (as sense or anti-sense ssDNA or ssRNA, dsRNA or dsDNA) to determine their relative effectiveness in inducing the herbicidal phenotype. The effective segments are further subdivided into 50-60 polynucleotide fragments, prioritized by least homology, and reevaluated using topically applied polynucleotides. The effective 50-60 polynucleotide fragments are subdivided into 19-30 polynucleotide fragments, prioritized by least homology, and again evaluated for induction of the yield/quality phenotype. Once relative effectiveness is determined, the fragments are utilized singly, or again evaluated in combination with one or more other fragments to determine the trigger composition or mixture of trigger polynucleotides for providing the yield/quality phenotype.

Trigger molecules for broad activity can be identified from coding and/or non-coding sequences of gene families of a plant or multiple plants, by aligning and selecting 200-300 polynucleotide fragments from the most homologous regions amongst the aligned sequences and evaluated using topically applied polynucleotides (as sense or anti-sense ssDNA or ssRNA, dsRNA or dsDNA) to determine their relative effectiveness in inducing the yield/quality phenotype. The effective segments are subdivided into 50-60 polynucleotide fragments, prioritized by most homology, and reevaluated using topically applied polynucleotides. The effective 50-60 polynucleotide fragments are subdivided into 19-30 polynucleotide fragments, prioritized by most homology, and again evaluated for induction of the yield/quality phenotype. Once relative effectiveness is determined, the fragments may be utilized singly, or in combination with one or more other fragments to determine the trigger composition or mixture of trigger polynucleotides for providing the yield/quality phenotype.

Methods of making polynucleotides are well known in the art. Chemical synthesis, in vivo synthesis and in vitro synthesis methods and compositions are known in the art and include various viral elements, microbial cells, modified polymerases, and modified nucleotides. Commercial preparation of oligonucleotides often provides two deoxyribonucleotides on the 3' end of the sense strand. Long polynucleotide molecules can be synthesized from commercially available kits, for example, kits from Applied Biosystems/Ambion (Austin, Tex.) have DNA ligated on the 5' end in a microbial expression cassette that includes a bacterial T7 polymerase promoter that makes RNA strands that can be assembled into a dsRNA and kits provided by various manufacturers that include T7 RiboMax Express (Promega, Madison, Wis.), AmpliScribe T7-Flash (Epicentre, Madison, Wis.), and TranscriptAid T7 High Yield (Fermentas, Glen Burnie, Md.). dsRNA molecules can be produced from microbial expression cassettes in bacterial cells (Ongvarrasopone et al., *ScienceAsia*, 33:35-39; Yin, *Appl. Microbiol. Biotechnol*, 84:323-333, 2009; Liu et al., *BMC Biotechnology*, 10:85, 2010) that have regulated or deficient RNase III enzyme activity or the use of various viral vectors to produce sufficient quantities of dsRNA. PPG oxidase gene fragments are inserted into the microbial expression cassettes in a position in which the fragments are expressed to produce ssRNA or dsRNA useful in the methods described herein to regulate expression on a target PPG oxidase gene. Long polynucleotide molecules can also be assembled from multiple RNA or DNA fragments. In some embodiments design parameters such as Reynolds score (Reynolds et al., *Nature Biotechnology*, 22:326-330 (2004), Tuschl rules (Pei and Tuschl, *Nature Methods*, 3(9): 670-676, 2006), i-score (*Nucleic Acids Res*, 35:e123, 2007), i-Score Designer tool and associated algorithms (*Nucleic Acids Res*, 32:936-948, 2004; *Biochem Biophys Res Commun*, 316:1050-1058, 2004; *Nucleic Acids Res*, 32:893-901, 2004; *Cell Cycle*, 3: 790-5, 2004; *Nat Biotechnol*, 23:995-1001, 2005; *Nucleic Acids Res*, 35:e27, 2007; *BMC Bioinformatics*, 7:520, 2006; *Nucleic Acids Res*, 35:e123, 2007, *Nat Biotechnol*, 22:326-330, 2004) are known in the art and may be used in selecting polynucleotide sequences effective in gene silencing. In some embodiments, the sequence of a polynucleotide is screened against the genomic DNA of the intended plant to minimize unintentional silencing of other genes.

The trigger polynucleotide and oligonucleotide molecule compositions are useful in compositions, such as liquids that comprise these polynucleotide molecules, at low concentrations, alone or in combination with other components, for example one or more herbicide molecules, either in the same solution or in separately applied liquids that also provide a transfer agent. While there is no upper limit on the concentrations and dosages of polynucleotide molecules that can useful in the methods, lower effective concentrations and dosages will generally be sought for efficiency. The concentrations can be adjusted in consideration of the volume of spray or treatment applied to plant leaves or other plant part surfaces, such as flower petals, stems, tubers, fruit, anthers, pollen, or seed. In one embodiment, a useful treatment for herbaceous plants using 25-mer oligonucleotide molecules is about 1 nanomole (nmol) of oligonucleotide molecules per plant, for example, from about 0.05 to 1 nmol per plant. Other embodiments for herbaceous plants include useful ranges of about 0.05 to about 100 nmol, or about 0.1 to about 20 nmol, or about 1 nmol to about 10 nmol of polynucleotides per plant. Very large plants, trees, or vines may require correspondingly larger amounts of polynucleotides. When using long dsRNA molecules that can be processed into multiple oligonucleotides, lower concentrations can be used. To illustrate certain embodiments, the factor 1×, when applied to oligonucleotide molecules is arbitrarily used to denote a treatment of 0.8 nmol of polynucleotide molecule per plant; 10×, 8 nmol of polynucleotide molecule per plant; and 100×, 80 nmol of polynucleotide molecule per plant.

The polynucleotide compositions are useful in compositions, such as liquids that comprise polynucleotide molecules, alone or in combination with other components either in the same liquid or in separately applied liquids that provide a transfer agent. As used herein, a transfer agent is an agent that, when combined with a polynucleotide in a composition that is topically applied to a target plant surface, enables the polynucleotide to enter a plant cell. In certain embodiments, a transfer agent is an agent that conditions the surface of plant tissue, e.g., leaves, stems, roots, flowers, or fruits, to permeation by the polynucleotide molecules into plant cells. The transfer of polynucleotides into plant cells can be facilitated by the prior or contemporaneous application of a polynucleotide-transferring agent to the plant tissue. In some embodiments, the transferring agent is applied subsequent to the application of the polynucleotide composition. The polynucleotide transfer agent enables a pathway for polynucleotides through cuticle wax barriers, stomata and/or cell wall or membrane barriers into plant cells. Suitable transfer agents to facilitate transfer of the polynucleotide into a plant cell include agents that increase permeability of the exterior of the plant or that increase permeability of plant cells to oligonucleotides or polynucleotides. Such agents to facilitate transfer of the composition into a plant cell include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. Embodiments of the method can optionally include an incubation step, a neutralization step (e.g., to neutralize an acid, base, or oxidizing agent, or to inactivate an enzyme), a rinsing step, or combinations thereof. Embodiments of agents or treatments for conditioning of a plant to permeation by polynucleotides include emulsions, reverse emulsions, liposomes, and other micellar-like compositions. Embodiments of agents or treatments for conditioning of a plant to permeation by polynucleotides include counter-ions or other molecules that are known to associate with nucleic acid molecules, e.g., inorganic ammonium ions, alkyl ammonium ions, lithium ions, polyamines such as spermine, spermidine, or putrescine, and other cations. Organic solvents useful in conditioning a plant to permeation by polynucleotides include DMSO, DMF, pyridine, N-pyrrolidine, hexamethylphosphoramide, acetonitrile, dioxane, polypropylene glycol, other solvents miscible with water or that will dissolve phosphonucleotides in non-aqueous systems (such as is used in synthetic reactions). Naturally derived or synthetic oils with or without surfactants or emulsifiers can be used, e.g., plant-sourced oils, crop oils (such as those listed in the 9$^{th}$ Compendium of Herbicide Adjuvants, publicly available on the worldwide web (internet) at herbicide.adjuvants.com) can be used, e.g., paraffinic oils, polyol fatty acid esters, or oils with short-chain molecules modified with amides or polyamines such as polyethyleneimine or N-pyrrolidine. Transfer agents include, but are not limited to, organosilicone preparations.

Ligands can be tethered to a polynucleotide, for example, a dsRNA, ssRNA, dsDNA or ssDNA. Ligands in general can include modifiers, e.g., for enhancing uptake; diagnostic compounds or reporter groups, e.g., for monitoring distribution; cross-linking agents; nuclease-resistance conferring moieties; and natural or unusual nucleobases. General examples include lipophiles, lipids (e.g., cholesterol), a bile acid, or a fatty acid (e.g., lithocholic-oleyl, lauroyl, docosnyl, stearoyl, palmitoyl, myristoyl oleoyl, linoleoyl), steroids (e.g., uvaol, hecigenin, diosgenin), terpenes (e.g., triterpenes, e.g., sarsasapogenin, Friedelin, epifriedelanol derivatized lithocholic acid), vitamins (e.g., folic acid, vitamin A, biotin, pyridoxal), carbohydrates, proteins, protein binding agents, integrin targeting molecules, polycationics, peptides, polyamines, and peptide mimics. The ligand may also be a recombinant or synthetic molecule, such as a synthetic polymer, e.g., polyethylene glycol (PEG), PEG-40K, PEG-20K and PEG-5K. Other examples of ligands include lipophilic molecules, e.g., cholesterol, cholic acid, adamantane acetic acid, 1-pyrene butyric acid, dihydrotestosterone, glycerol (e.g., esters and ethers thereof, e.g., $C_{10}$, $C_{11}$, $C_{12}$, $C_{13}$, $C_{14}$, $C_{15}$, $C_{16}$, $C_{17}$, $C_{18}$, $C_{19}$, or $C_{20}$ alkyl; e.g., lauroyl, docosnyl, stearoyl, oleoyl, linoleoyl 1,3-bis-O (hexadecyl)glycerol, 1,3-bis-O(octaadecyl)glycerol), geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dodecanoyl, lithocholyl, 5.beta.-cholanyl, N,N-distearyl-lithocholamide, 1,2-di-O-stearoylglyceride, dimethoxytrityl, or phenoxazine) and PEG (e.g., PEG-5K, PEG-20K, PEG-40K). Preferred lipophilic moieties include lipid, cholesterols, oleyl, retinyl, or cholesteryl residues.

Conjugating a ligand to a dsRNA can enhance its cellular absorption, lipophilic compounds that have been conjugated to oligonucleotides include 1-pyrene butyric acid, 1,3-bis-O-(hexadecyl)glycerol, and menthol. One example of a ligand for receptor-mediated endocytosis is folic acid. Folic acid enters the cell by folate-receptor-radiated endocytosis. dsRNA compounds bearing folic acid would be efficiently transported into the cell via the folate-receptor-mediated endocytosis. Other ligands that have been conjugated to oligonucleotides include polyethylene glycols, carbohydrate clusters, cross-linking agents, porphyrin conjugates, delivery peptides and lipids such as cholesterol. In certain instances, conjugation of a cationic ligand to oligonucleotides results in improved resistance to nucleases. Representative examples of cationic ligands are propylammonium and dimethylpropylammonium. Interestingly, antisense oligonucleotides were reported to retain their high binding affinity to mRNA when the cationic ligand was dispersed, throughout the oligonucleotide. See Manoharan, *Antisense Nucleic Acid Drug Dev.*, 12(2):103-128 (2002) and references therein.

A biologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic and neutral lipids commonly used to transfect cells in vitro. Cationic lipids can complex (e.g., charge-associate) with negatively charged, nucleic acids to form liposomes. Examples of cationic liposomes include, without limitation, LIPOFECTIN® (Invitrogen/Life Technologies, Carlsbad, Calif., a 1:1 (w.w) liposome formulation of the cationic lipid N-[1-(2,3-dioleyloxy)propyl]-n,n,n-trimethylammonium chloride (DOTMA) and dioleoyl phophotidylethanolamine (DOPE)), LIPOFECTAMINE® *Invitrogen/Life Technologies, Carlsbad, Calif., a proprietary cationic liposome formulation), LIPOFECTACE® (Invitrogen/Life Technologies, Carlsbad, Calif., a liposome formulation of dimethyldioctadecyloammonium bromide (DDAB) and DOPE), and DOTAP. Procedures for forming liposomes are well known in the art. Liposome compositions can be formed, for example, from phosphatidylcholine, dimyristoyl phosphatidylcholine, dipalmitoyl phosphatidylcholine, dimyristoyl phosphatidyl glycerol, dioleoyl phosphatidylethanolamine or liposomes comprising dihydrosphingomyelin (DHSM). Numerous lipophilic agents are commercially available, including LIPOFECTIN® (Invitrogen/Life Technologies, Carlsbad, Calif.) and EFFECTENE™ (Qiagen, Valencia, Calif., a proprietary non-liposomal lipid formulation). In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al., *Nature Biotechnology*, 15:647-652 (1997) can be used. In other embodiments, polycations such as polyethyleneimine can be used to achieve delivery in vivo and ex vivo (Boletta et al., *J. Am Soc. Nephrol.*, 7:1728, 1996). Additional information regarding the use of liposomes to deliver nucleic acids can be found in U.S. Pat. No. 6,271,359, PCT Publication WO 96/40964, and Morrissey, D. et al., 2005, *Nature Biotechnol.* 23(8):1002-7.

In certain embodiments, an organosilicone preparation that is commercially available as Silwet® L-77 surfactant having CAS Number 27306-78-1 and EPA Number: CAL-.REG.NO. 5905-50073-AA, and currently available from Momentive Performance Materials, Albany, N.Y., can be used to prepare a polynucleotide composition. In certain embodiments where a Silwet L-77 organosilicone preparation is used as a pre-spray treatment of plant leaves or other plant surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation comprising Silwet L-77 in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

In certain embodiments, any of the commercially available organosilicone preparations provided such as the following Breakthru S 321, Breakthru S 200 Cat #67674-67-3, Breakthru OE 441 Cat #68937-55-3, Breakthru S 278 Cat #27306-78-1, Breakthru S 243, Breakthru S 233 Cat #134180-76-0, available from manufacturer Evonik Goldschmidt (Germany), Silwet® HS 429, Silwet® HS 312, Silwet® HS 508, Silwet® HS 604 (Momentive Performance Materials, Albany, N.Y.) can be used as transfer agents in a polynucleotide composition. In certain embodiments where an organosilicone preparation is used as a pre-spray treatment of plant leaves or other surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Organosilicone preparations used in the methods and compositions provided herein can comprise one or more effective organosilicone compounds. As used herein, the phrase "effective organosilicone compound" is used to describe any organosilicone compound that is found in an organosilicone preparation that enables a polynucleotide to enter a plant cell. In certain embodiments, an effective organosilicone compound can enable a polynucleotide to enter a plant cell in a manner permitting a polynucleotide mediated suppression of a target gene expression in the plant cell. In general, effective organosilicone compounds include, but are not limited to, compounds that can comprise: i) a trisiloxane head group that is covalently linked to ii) an alkyl linker including, but not limited to, an n-propyl linker, that is covalently linked to iii) a poly glycol chain, that is covalently linked to iv) a terminal group. Trisiloxane head groups of such effective organosilicone compounds include, but are not limited to, heptamethyltrisiloxane. Alkyl linkers can include, but are not limited to, an n-propyl linker. Poly glycol chains include, but are not limited to, polyethylene glycol or polypropylene glycol. Poly glycol chains can comprise a mixture that provides an average chain length "n" of about "7.5." In certain embodiments, the average chain length "n" can vary from about 5 to about 14. Terminal groups can include, but are not limited to, alkyl groups such as a methyl group. Effective organosilicone compounds are believed to include, but are not limited to, trisiloxane ethoxylate surfactants or polyalkylene oxide modified heptamethyl trisiloxane.

Compound I

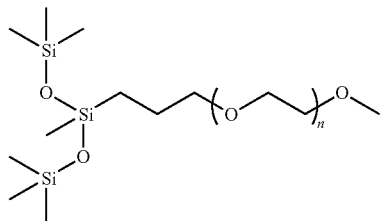

(polyalkyleneoxide heptamethyltrisiloxane, average n = 7.5.)

In certain embodiments, an organosilicone preparation that comprises an organosilicone compound comprising a trisiloxane head group is used in the methods and compositions provided herein. In certain embodiments, an organosilicone preparation that comprises an organosilicone compound comprising a heptamethyltrisiloxane head group is used in the methods and compositions provided herein. In certain embodiments, an organosilicone composition that comprises Compound I is used in the methods and compositions provided herein. In certain embodiments, an organosilicone composition that comprises Compound I is used in the methods and compositions provided herein. In certain embodiments of the methods and compositions provided herein, a composition that comprises a polynucleotide molecule and one or more effective organosilicone compounds in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Compositions include but are not limited components that are one or more polynucleotides essentially identical to, or essentially complementary to, a PPG oxidase gene sequence (promoter, intron, exon, 5' untranslated region, 3' untranslated region), a transfer agent that provides for the polynucleotide to enter a plant cell, a herbicide that complements the action of the polynucleotide, one or more additional herbicides that further enhance the herbicide activity of the composition or provide an additional mode of action different from the complementing herbicide, various salts and stabilizing agents that enhance the utility of the composition as an admixture of the components of the composition.

The methods include one or more applications of a polynucleotide composition and one or more applications of a permeability-enhancing agent for conditioning of a plant to permeation by polynucleotides. When the agent for conditioning to permeation is an organosilicone composition or compound contained therein, embodiments of the polynucleotide molecules are double-stranded RNA oligonucleotides, single-stranded RNA oligonucleotides, double-stranded RNA polynucleotides, single-stranded RNA polynucleotides, double-stranded DNA oligonucleotides, single-stranded DNA oligonucleotides, double-stranded DNA polynucleotides, single-stranded DNA polynucleotides, chemically modified RNA or DNA oligonucleotides or polynucleotides or mixtures thereof.

Compositions and methods are useful for modulating the expression of an endogenous PPG oxidase gene (for example, U.S. Pat. Nos. 7,838,263 and 6,084,155) or transgenic PPG oxidase gene (U.S. Pat. Nos. 7,842,856 and 7,485,777; US Patent Publ. 20070050863) in a plant cell. In various embodiments, a PPG oxidase gene includes coding (protein-coding or translatable) sequence, non-coding (non-translatable) sequence, or both coding and non-coding sequence. Compositions can include polynucleotides and oligonucleotides designed to target multiple genes, or multiple segments of one or more genes. The target gene can include multiple consecutive segments of a target gene, multiple non-consecutive segments of a target gene, multiple alleles of a target gene, or multiple target genes from one or more species.

A method is provided for modulating expression of a PPG oxidase gene in a plant including (a) conditioning of a plant to permeation by polynucleotides and (b) treatment of the plant with the polynucleotide molecules, wherein the polynucleotide molecules include at least one segment of 18 or more contiguous nucleotides cloned from or otherwise identified from the target PPG oxidase gene in either anti-sense or sense orientation, whereby the polynucleotide molecules permeate the interior of the plant and induce modulation of the target gene. The conditioning and polynucleotide application can be performed separately or in a single step. When the conditioning and polynucleotide application are performed in separate steps, the conditioning can precede or can follow the polynucleotide application within minutes, hours, or days. In some embodiments more than one conditioning step or more than one polynucleotide molecule application can be performed on the same plant. In embodiments of the method, the segment can be cloned or identified from (a) coding (protein-encoding), (b) non-coding (promoter and other gene related molecules), or (c) both coding and non-coding parts of the target gene. Non-coding parts include DNA, such as promoter regions or the RNA transcribed by the DNA that provide RNA regulatory molecules, including but not limited to: introns, 5' or 3' untranslated regions, and microRNAs (miRNA), trans-acting siRNAs, natural antisense siRNAs, and other small RNAs with regulatory function or RNAs having structural or enzymatic function including but not limited to: ribozymes, ribosomal RNAs, t-RNAs, aptamers, and riboswitches.

All publications, patents and patent applications are herein incorporated by reference to the same extent as if each individual publication or patent application was specifically and individually indicated to be incorporated by reference.

The following examples are included to demonstrate examples of certain preferred embodiments. It should be appreciated by those of skill in the art that the techniques disclosed in the examples that follow represent approaches the inventors have found function well in the practice of the invention, and thus can be considered to constitute examples of preferred modes for its practice. However, those of skill in the art should, in light of the present disclosure, appreciate that many changes can be made in the specific embodiments that are disclosed and still obtain a like or similar result without departing from the spirit and scope of the invention.

EXAMPLES

Example 1. Polynucleotides Related to the PPG Oxidase Gene Sequences

The target PPG oxidase polynucleotide molecule naturally occurs in the genome of *Amaranthus albus*, *Amaranthus graecizans*, *Amaranthus hybridus*, *Amaranthus lividus*, *Amaranthus palmeri*, *Amaranthus rudis*, *Amaranthus spinosus*, *Amaranthus thunbergii*, *Amaranthus viridis*, *Ambrosia trifida*, *Chenopodium album*, *Commelina diffusa*, *Conyza canadensis*, *Digitaria sanguinalis*, *Euphorbia heterophylla*, *Kochia scoparia*, or *Lolium multiflorum* and include molecules related to the expression of a polypeptide identified as a PPG oxidase, that include regulatory molecules, cDNAs comprising coding and noncoding regions of a PPG oxidase gene and fragments thereof as shown in Table 1.

Polynucleotide molecules were extracted from these plant species by methods standard in the field, for example, total RNA was extracted using Trizol Reagent (Invitrogen Corp, Carlsbad, Calif. Cat. No. 15596-018), following the manufacturer's protocol or modifications thereof by those skilled in the art of polynucleotide extraction that may enhance recovery or purity of the extracted RNA. Briefly, start with 1 gram of ground plant tissue for extraction. Prealiquot 10 milliliters (mL) Trizol reagent to 15 mL conical tubes. Add ground powder to tubes and shake to homogenize. Incubate the homogenized samples for 5 minutes (min) at room temperature (RT) and then add 3 mL of chloroform. Shake tubes vigorously by hand for 15-30 seconds (sec) and incubate at RT for 3 min. Centrifuge the tubes at 7,000 revolutions per minute (rpm) for 10 min at 4 degrees C. Transfer the aqueous phase to a new 1.5 mL tube and add 1 volume of cold isopropanol. Incubate the samples for 20-30 min at RT and centrifuge at 10,000 rpm for 10 min at 4 degrees C. Wash pellet with Sigma-grade 80 percent ethanol. Remove the supernatant and briefly air-dry the pellet. Dissolve the RNA pellet in approximately 200 microliters of DEPC treated water. Heat briefly at 65 degrees C. to dissolve pellet and vortex or pipet to resuspend RNA pellet. Adjust RNA concentration to 1-2 microgram/microliter.

DNA is extracted using EZNA SP Plant DNA Mini kit (Omega Biotek, Norcross Ga., Cat # D5511) and Lysing Matrix E tubes (Q-Biogen, Cat #6914), following the manufacturer's protocol or modifications thereof by those skilled in the art of polynucleotide extraction that may enhance recovery or purity of the extracted DNA. Briefly, aliquot ground tissue to a Lysing Matrix E tube on dry ice, add 800 μl Buffer SP1 to each sample, homogenize in a bead beater for 35-45 sec, incubate on ice for 45-60 sec, centrifuge at ≥14000 rpm for 1 min at RT, add 10 microliter RNase A to the lysate, incubate at 65° C. for 10 min, centrifuge for 1 min at RT, add 280 μl Buffer SP2 and vortex to mix, incubate the samples on ice for 5 min, centrifuge at ≥10,000 g for 10 min at RT, transfer the supernatant to a homogenizer column in a 2 ml collection tube, centrifuge at 10,000 g for 2 min at RT, transfer the cleared lysate into a 1.5 ml microfuge tube, add 1.5 volumes Buffer SP3 to the cleared lysate, vortex immediately to obtain a homogeneous mixture, transfer up to 650 μl supernatant to the Hi-Bind column, centrifuge at 10,000 g for 1 min, repeat, apply 100 μl 65° C. Elution Buffer to the column, centrifuge at 10,000 g for 5 min at RT.

Next-generation DNA sequencers, such as the 454-FLX (Roche, Branford, Conn.), the SOLiD (Applied Biosystems), and the Genome Analyzer (HiSeq2000, Illumina, San Diego, Calif.) are used to provide polynucleotide sequences from the DNA and RNA extracted from the plant tissues. Raw sequence data is assembled into contigs. The contig sequence is used to identify trigger molecules that can be applied to the plant to enable regulation of the gene expression.

The target DNA sequence isolated from genomic (gDNA) and coding DNA (cDNA) from the various weedy plant species for the PPG oxidase gene and the assembled contigs as set forth in SEQ ID Nos: 1-71 and Table 1 below.

TABLE 1

| SEQ ID NO | SPECIES | TYPE | LENGTH |
|---|---|---|---|
| 1 | Amaranthus albus | cDNA Contig | 1200 |
| 2 | Amaranthus albus | cDNA Contig | 487 |
| 3 | Amaranthus graecizans | cDNA Contig | 1847 |
| 4 | Amaranthus hybridus | cDNA Contig | 1170 |
| 5 | Amaranthus lividus | cDNA Contig | 2344 |
| 6 | Amaranthus palmeri | cDNA Contig | 1866 |
| 7 | Amaranthus palmeri | cDNA Contig | 1066 |
| 8 | Amaranthus palmeri | cDNA Contig | 294 |
| 9 | Amaranthus palmeri | gDNA Contig | 6448 |
| 10 | Amaranthus palmeri | gDNA Contig | 5240 |
| 11 | Amaranthus palmeri | gDNA Contig | 2936 |
| 12 | Amaranthus palmeri | gDNA Contig | 1923 |
| 13 | Amaranthus palmeri | gDNA Contig | 2787 |
| 14 | Amaranthus palmeri | gDNA Contig | 2379 |
| 15 | Amaranthus palmeri | gDNA Contig | 760 |
| 16 | Amaranthus rudis | cDNA Contig | 1872 |
| 17 | Amaranthus rudis | cDNA Contig | 1605 |
| 18 | Amaranthus rudis | cDNA Contig | 1238 |
| 19 | Amaranthus rudis | cDNA Contig | 635 |
| 20 | Amaranthus rudis | gDNA Contig | 5704 |
| 21 | Amaranthus rudis | gDNA Contig | 1031 |
| 22 | Amaranthus rudis | gDNA Contig | 1017 |
| 23 | Amaranthus rudis | gDNA Contig | 630 |

TABLE 1-continued

| SEQ ID NO | SPECIES | TYPE | LENGTH |
|---|---|---|---|
| 24 | *Amaranthus rudis* | gDNA Contig | 612 |
| 25 | *Amaranthus rudis* | gDNA Contig | 487 |
| 26 | *Amaranthus spinosus* | cDNA Contig | 1582 |
| 27 | *Amaranthus thunbergii* | cDNA Contig | 1485 |
| 28 | *Amaranthus viridis* | cDNA Contig | 1808 |
| 29 | *Ambrosia trifida* | cDNA Contig | 1829 |
| 30 | *Ambrosia trifida* | cDNA Contig | 921 |
| 31 | *Ambrosia trifida* | cDNA Contig | 811 |
| 32 | *Ambrosia trifida* | gDNA Contig | 4915 |
| 33 | *Ambrosia trifida* | gDNA Contig | 851 |
| 34 | *Ambrosia trifida* | gDNA Contig | 507 |
| 35 | *Chenopodium album* | cDNA Contig | 1648 |
| 36 | *Conyza canadensis* | cDNA Contig | 1653 |
| 37 | *Conyza canadensis* | cDNA Contig | 600 |
| 38 | *Conyza canadensis* | gDNA Contig | 10631 |
| 39 | *Conyza canadensis* | gDNA Contig | 10185 |
| 40 | *Conyza canadensis* | gDNA Contig | 2634 |
| 41 | *Euphorbia heterophylla* | cDNA Contig | 1631 |
| 42 | *Euphorbia heterophylla* | cDNA Contig | 480 |
| 43 | *Euphorbia heterophylla* | gDNA Contig | 4067 |
| 44 | *Euphorbia heterophylla* | gDNA Contig | 2630 |
| 45 | *Euphorbia heterophylla* | gDNA Contig | 1010 |
| 46 | *Euphorbia heterophylla* | gDNA Contig | 855 |
| 47 | *Euphorbia heterophylla* | gDNA Contig | 121 |
| 48 | *Euphorbia heterophylla* | gDNA Contig | 77 |
| 49 | *Commelina diffusa* | cDNA Contig | 444 |
| 50 | *Commelina diffusa* | gDNA Contig | 3043 |
| 51 | *Commelina diffusa* | gDNA Contig | 1559 |
| 52 | *Commelina diffusa* | gDNA Contig | 589 |
| 53 | *Digitaria sanguinalis* | cDNA Contig | 876 |
| 54 | *Digitaria sanguinalis* | cDNA Contig | 518 |
| 55 | *Digitaria sanguinalis* | cDNA Contig | 387 |
| 56 | *Digitaria sanguinalis* | gDNA Contig | 2697 |
| 57 | *Digitaria sanguinalis* | gDNA Contig | 1089 |
| 58 | *Kochia scoparia* | cDNA Contig | 1518 |
| 59 | *Kochia scoparia* | cDNA Contig | 963 |
| 60 | *Kochia scoparia* | cDNA Contig | 564 |
| 61 | *Kochia scoparia* | cDNA Contig | 516 |
| 62 | *Lolium multiflorum* | cDNA Contig | 1185 |
| 63 | *Lolium multiflorum* | cDNA Contig | 258 |
| 64 | *Lolium multiflorum* | cDNA Contig | 201 |
| 65 | *Lolium multiflorum* | cDNA Contig | 150 |
| 66 | *Lolium multiflorum* | cDNA Contig | 144 |
| 67 | *Lolium multiflorum* | cDNA Contig | 114 |
| 68 | *Lolium multiflorum* | cDNA Contig | 108 |
| 69 | *Lolium multiflorum* | gDNA Contig | 3037 |
| 70 | *Lolium multiflorum* | gDNA Contig | 795 |
| 71 | *Lolium multiflorum* | gDNA Contig | 381 |

Example 2. Polynucleotides Related to the Trigger Molecules

The gene sequences and fragments of Table 1 were divided into 200 polynucleotide (200-mer) lengths with 25 polynucleotide overlapping regions and are shown in Table 2, SEQ ID NOs:72-429. These polynucleotides are tested to select the most efficacious trigger regions across the length of any target sequence. The trigger polynucleotides are constructed as sense or anti-sense ssDNA or ssRNA, dsRNA or dsDNA, or dsDNA/RNA hybrids and combined with an organosilicone based transfer agent to provide a polynucleotide preparation. The polynucleotides are combined into sets of two to three polynucleotides per set, using 4-8 nmol of each polynucleotide. Each polynucleotide set is prepared with the transfer agent and applied to a plant or a field of plants in combination with a PPG oxidase inhibitor containing herbicide, or followed by a PPG oxidase inhibitor treatment one to three days after the polynucleotide application, to determine the effect on the plant's susceptibility to a PPG oxidase inhibitor. The effect is measured as stunting the growth and/or killing of the plant and is measured 8-14 days after treatment with the polynucleotide set and PPG oxidase inhibitor. The most efficacious sets are identified and the individual polynucleotides are tested in the same methods as the sets are and the most efficacious single 200-mer identified. The 200-mer sequence is divided into smaller sequences of 50-70-mer regions with 10-15 polynucleotide overlapping regions and the polynucleotides tested individually. The most efficacious 50-70-mer is further divided into smaller sequences of 25-mer regions with a 12 to 13 polynucleotide overlapping region and tested for efficacy in combination with PPG oxidase inhibitor treatment. By this method, it is possible to identify an oligonucleotide or several oligonucleotides that are the most efficacious trigger molecule to effect plant sensitivity to a PPG oxidase inhibitor or modulation of a PPG oxidase gene expression. The modulation of PPG oxidase gene expression is determined by the detection of PPG oxidase siRNA molecules specific to a PPG oxidase gene or by an observation of a reduction in the amount of PPG oxidase RNA transcript produced relative to an untreated plant or by merely observing the anticipated phenotype of the application of the trigger with the PPG oxidase inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the PPG oxidase gene and the assembled contigs as set forth in SEQ ID Nos: 1-71 were divided into polynucleotide fragments as shown in Table 2 below and as set forth in SEQ ID Nos: 72-1381.

TABLE 2

| SEQ ID NO | Species | Name | Reference | Type | Start | End |
|---|---|---|---|---|---|---|
| 72 | *Amaranthus albus* | PPOX_B1_1 | cDNA Contig | 1 | 200 |
| 73 | *Amaranthus albus* | PPOX_B1_1 | cDNA Contig | 1 | 200 |
| 74 | *Amaranthus albus* | PPOX_B1_2 | cDNA Contig | 176 | 375 |
| 75 | *Amaranthus albus* | PPOX_B1_2 | cDNA Contig | 176 | 375 |
| 76 | *Amaranthus albus* | PPOX_B1_3 | cDNA Contig | 351 | 550 |
| 77 | *Amaranthus albus* | PPOX_B1_3 | cDNA Contig | 351 | 550 |
| 78 | *Amaranthus albus* | PPOX_B1_4 | cDNA Contig | 526 | 725 |
| 79 | *Amaranthus albus* | PPOX_B1_4 | cDNA Contig | 526 | 725 |
| 80 | *Amaranthus albus* | PPOX_B1_5 | cDNA Contig | 701 | 900 |
| 81 | *Amaranthus albus* | PPOX_B1_5 | cDNA Contig | 701 | 900 |
| 82 | *Amaranthus albus* | PPOX_B1_6 | cDNA Contig | 876 | 1075 |
| 83 | *Amaranthus albus* | PPOX_B1_6 | cDNA Contig | 876 | 1075 |
| 84 | *Amaranthus albus* | PPOX_B2_1 | cDNA Contig | 1 | 200 |
| 85 | *Amaranthus albus* | PPOX_B2_1 | cDNA Contig | 1 | 200 |

TABLE 2-continued

| SEQ ID NO | Species | Name / Reference | Type | Start | End |
|---|---|---|---|---|---|
| 86 | Amaranthus albus | PPOX_B2_2 | cDNA Contig | 176 | 375 |
| 87 | Amaranthus albus | PPOX_B2_2 | cDNA Contig | 176 | 375 |
| 88 | Amaranthus graecizans | PPOX_B3_1 | cDNA Contig | 1 | 200 |
| 89 | Amaranthus graecizans | PPOX_B3_1 | cDNA Contig | 1 | 200 |
| 90 | Amaranthus graecizans | PPOX_B3_2 | cDNA Contig | 176 | 375 |
| 91 | Amaranthus graecizans | PPOX_B3_2 | cDNA Contig | 176 | 375 |
| 92 | Amaranthus graecizans | PPOX_B3_3 | cDNA Contig | 351 | 550 |
| 93 | Amaranthus graecizans | PPOX_B3_3 | cDNA Contig | 351 | 550 |
| 94 | Amaranthus graecizans | PPOX_B3_4 | cDNA Contig | 526 | 725 |
| 95 | Amaranthus graecizans | PPOX_B3_4 | cDNA Contig | 526 | 725 |
| 96 | Amaranthus graecizans | PPOX_B3_5 | cDNA Contig | 701 | 900 |
| 97 | Amaranthus graecizans | PPOX_B3_5 | cDNA Contig | 701 | 900 |
| 98 | Amaranthus graecizans | PPOX_B3_6 | cDNA Contig | 876 | 1075 |
| 99 | Amaranthus graecizans | PPOX_B3_6 | cDNA Contig | 876 | 1075 |
| 100 | Amaranthus graecizans | PPOX_B3_7 | cDNA Contig | 1051 | 1250 |
| 101 | Amaranthus graecizans | PPOX_B3_7 | cDNA Contig | 1051 | 1250 |
| 102 | Amaranthus graecizans | PPOX_B3_8 | cDNA Contig | 1226 | 1425 |
| 103 | Amaranthus graecizans | PPOX_B3_8 | cDNA Contig | 1226 | 1425 |
| 104 | Amaranthus graecizans | PPOX_B3_9 | cDNA Contig | 1401 | 1600 |
| 105 | Amaranthus graecizans | PPOX_B3_9 | cDNA Contig | 1401 | 1600 |
| 106 | Amaranthus graecizans | PPOX_B3_10 | cDNA Contig | 1576 | 1775 |
| 107 | Amaranthus graecizans | PPOX_B3_10 | cDNA Contig | 1576 | 1775 |
| 108 | Amaranthus hybridus | PPOX_B4_1 | cDNA Contig | 1 | 200 |
| 109 | Amaranthus hybridus | PPOX_B4_1 | cDNA Contig | 1 | 200 |
| 110 | Amaranthus hybridus | PPOX_B4_2 | cDNA Contig | 176 | 375 |
| 111 | Amaranthus hybridus | PPOX_B4_2 | cDNA Contig | 176 | 375 |
| 112 | Amaranthus hybridus | PPOX_B4_3 | cDNA Contig | 351 | 550 |
| 113 | Amaranthus hybridus | PPOX_B4_3 | cDNA Contig | 351 | 550 |
| 114 | Amaranthus hybridus | PPOX_B4_4 | cDNA Contig | 526 | 725 |
| 115 | Amaranthus hybridus | PPOX_B4_4 | cDNA Contig | 526 | 725 |
| 116 | Amaranthus hybridus | PPOX_B4_5 | cDNA Contig | 701 | 900 |
| 117 | Amaranthus hybridus | PPOX_B4_5 | cDNA Contig | 701 | 900 |
| 118 | Amaranthus hybridus | PPOX_B4_6 | cDNA Contig | 876 | 1075 |
| 119 | Amaranthus hybridus | PPOX_B4_6 | cDNA Contig | 876 | 1075 |
| 120 | Amaranthus lividus | PPOX_B5_1 | cDNA Contig | 1 | 200 |
| 121 | Amaranthus lividus | PPOX_B5_1 | cDNA Contig | 1 | 200 |
| 122 | Amaranthus lividus | PPOX_B5_2 | cDNA Contig | 176 | 375 |
| 123 | Amaranthus lividus | PPOX_B5_2 | cDNA Contig | 176 | 375 |
| 124 | Amaranthus lividus | PPOX_B5_3 | cDNA Contig | 351 | 550 |
| 125 | Amaranthus lividus | PPOX_B5_3 | cDNA Contig | 351 | 550 |
| 126 | Amaranthus lividus | PPOX_B5_4 | cDNA Contig | 526 | 725 |
| 127 | Amaranthus lividus | PPOX_B5_4 | cDNA Contig | 526 | 725 |
| 128 | Amaranthus lividus | PPOX_B5_5 | cDNA Contig | 701 | 900 |
| 129 | Amaranthus lividus | PPOX_B5_5 | cDNA Contig | 701 | 900 |
| 130 | Amaranthus lividus | PPOX_B5_6 | cDNA Contig | 876 | 1075 |
| 131 | Amaranthus lividus | PPOX_B5_6 | cDNA Contig | 876 | 1075 |
| 132 | Amaranthus lividus | PPOX_B5_7 | cDNA Contig | 1051 | 1250 |
| 133 | Amaranthus lividus | PPOX_B5_7 | cDNA Contig | 1051 | 1250 |
| 134 | Amaranthus lividus | PPOX_B5_8 | cDNA Contig | 1226 | 1425 |
| 135 | Amaranthus lividus | PPOX_B5_8 | cDNA Contig | 1226 | 1425 |
| 136 | Amaranthus lividus | PPOX_B5_9 | cDNA Contig | 1401 | 1600 |
| 137 | Amaranthus lividus | PPOX_B5_9 | cDNA Contig | 1401 | 1600 |
| 138 | Amaranthus lividus | PPOX_B5_10 | cDNA Contig | 1576 | 1775 |
| 139 | Amaranthus lividus | PPOX_B5_10 | cDNA Contig | 1576 | 1775 |
| 140 | Amaranthus lividus | PPOX_B5_11 | cDNA Contig | 1751 | 1950 |
| 141 | Amaranthus lividus | PPOX_B5_11 | cDNA Contig | 1751 | 1950 |
| 142 | Amaranthus lividus | PPOX_B5_12 | cDNA Contig | 1926 | 2125 |
| 143 | Amaranthus lividus | PPOX_B5_12 | cDNA Contig | 1926 | 2125 |
| 144 | Amaranthus lividus | PPOX_B5_13 | cDNA Contig | 2101 | 2300 |
| 145 | Amaranthus lividus | PPOX_B5_13 | cDNA Contig | 2101 | 2300 |
| 146 | Amaranthus palmeri | PPOX_B6_1 | cDNA Contig | 1 | 200 |
| 147 | Amaranthus palmeri | PPOX_B6_1 | cDNA Contig | 1 | 200 |
| 148 | Amaranthus palmeri | PPOX_B6_2 | cDNA Contig | 176 | 375 |
| 149 | Amaranthus palmeri | PPOX_B6_2 | cDNA Contig | 176 | 375 |
| 150 | Amaranthus palmeri | PPOX_B6_3 | cDNA Contig | 351 | 550 |
| 151 | Amaranthus palmeri | PPOX_B6_3 | cDNA Contig | 351 | 550 |
| 152 | Amaranthus palmeri | PPOX_B6_4 | cDNA Contig | 526 | 725 |
| 153 | Amaranthus palmeri | PPOX_B6_4 | cDNA Contig | 526 | 725 |
| 154 | Amaranthus palmeri | PPOX_B6_5 | cDNA Contig | 701 | 900 |
| 155 | Amaranthus palmeri | PPOX_B6_5 | cDNA Contig | 701 | 900 |
| 156 | Amaranthus palmeri | PPOX_B6_6 | cDNA Contig | 876 | 1075 |
| 157 | Amaranthus palmeri | PPOX_B6_6 | cDNA Contig | 876 | 1075 |
| 158 | Amaranthus palmeri | PPOX_B6_7 | cDNA Contig | 1051 | 1250 |
| 159 | Amaranthus palmeri | PPOX_B6_7 | cDNA Contig | 1051 | 1250 |
| 160 | Amaranthus palmeri | PPOX_B6_8 | cDNA Contig | 1226 | 1425 |
| 161 | Amaranthus palmeri | PPOX_B6_8 | cDNA Contig | 1226 | 1425 |
| 162 | Amaranthus palmeri | PPOX_B6_9 | cDNA Contig | 1401 | 1600 |

TABLE 2-continued

| SEQ ID NO | Species | Name / Reference | Type | Start | End |
|---|---|---|---|---|---|
| 163 | Amaranthus palmeri | PPOX_B6_9 | cDNA Contig | 1401 | 1600 |
| 164 | Amaranthus palmeri | PPOX_B6_10 | cDNA Contig | 1576 | 1775 |
| 165 | Amaranthus palmeri | PPOX_B6_10 | cDNA Contig | 1576 | 1775 |
| 166 | Amaranthus palmeri | PPOX_B13_1 | gDNA Contig | 1 | 200 |
| 167 | Amaranthus palmeri | PPOX_B13_1 | gDNA Contig | 1 | 200 |
| 168 | Amaranthus palmeri | PPOX_B13_2 | gDNA Contig | 176 | 375 |
| 169 | Amaranthus palmeri | PPOX_B13_2 | gDNA Contig | 176 | 375 |
| 170 | Amaranthus palmeri | PPOX_B13_3 | gDNA Contig | 351 | 550 |
| 171 | Amaranthus palmeri | PPOX_B13_3 | gDNA Contig | 351 | 550 |
| 172 | Amaranthus palmeri | PPOX_B13_4 | gDNA Contig | 526 | 725 |
| 173 | Amaranthus palmeri | PPOX_B13_4 | gDNA Contig | 526 | 725 |
| 174 | Amaranthus palmeri | PPOX_B13_5 | gDNA Contig | 701 | 900 |
| 175 | Amaranthus palmeri | PPOX_B13_5 | gDNA Contig | 701 | 900 |
| 176 | Amaranthus palmeri | PPOX_B13_6 | gDNA Contig | 876 | 1075 |
| 177 | Amaranthus palmeri | PPOX_B13_6 | gDNA Contig | 876 | 1075 |
| 178 | Amaranthus palmeri | PPOX_B13_7 | gDNA Contig | 1051 | 1250 |
| 179 | Amaranthus palmeri | PPOX_B13_7 | gDNA Contig | 1051 | 1250 |
| 180 | Amaranthus palmeri | PPOX_B13_8 | gDNA Contig | 1226 | 1425 |
| 181 | Amaranthus palmeri | PPOX_B13_8 | gDNA Contig | 1226 | 1425 |
| 182 | Amaranthus palmeri | PPOX_B13_9 | gDNA Contig | 1401 | 1600 |
| 183 | Amaranthus palmeri | PPOX_B13_9 | gDNA Contig | 1401 | 1600 |
| 184 | Amaranthus palmeri | PPOX_B13_10 | gDNA Contig | 1576 | 1775 |
| 185 | Amaranthus palmeri | PPOX_B13_10 | gDNA Contig | 1576 | 1775 |
| 186 | Amaranthus palmeri | PPOX_B13_11 | gDNA Contig | 1751 | 1950 |
| 187 | Amaranthus palmeri | PPOX_B13_11 | gDNA Contig | 1751 | 1950 |
| 188 | Amaranthus palmeri | PPOX_B13_12 | gDNA Contig | 1926 | 2125 |
| 189 | Amaranthus palmeri | PPOX_B13_12 | gDNA Contig | 1926 | 2125 |
| 190 | Amaranthus palmeri | PPOX_B13_13 | gDNA Contig | 2101 | 2300 |
| 191 | Amaranthus palmeri | PPOX_B13_13 | gDNA Contig | 2101 | 2300 |
| 192 | Amaranthus palmeri | PPOX_B13_14 | gDNA Contig | 2276 | 2475 |
| 193 | Amaranthus palmeri | PPOX_B13_14 | gDNA Contig | 2276 | 2475 |
| 194 | Amaranthus palmeri | PPOX_B13_15 | gDNA Contig | 2451 | 2650 |
| 195 | Amaranthus palmeri | PPOX_B13_15 | gDNA Contig | 2451 | 2650 |
| 196 | Amaranthus palmeri | PPOX_B10_1 | gDNA Contig | 1 | 200 |
| 197 | Amaranthus palmeri | PPOX_B10_1 | gDNA Contig | 1 | 200 |
| 198 | Amaranthus palmeri | PPOX_B10_2 | gDNA Contig | 176 | 375 |
| 199 | Amaranthus palmeri | PPOX_B10_2 | gDNA Contig | 176 | 375 |
| 200 | Amaranthus palmeri | PPOX_B10_3 | gDNA Contig | 351 | 550 |
| 201 | Amaranthus palmeri | PPOX_B10_3 | gDNA Contig | 351 | 550 |
| 202 | Amaranthus palmeri | PPOX_B10_4 | gDNA Contig | 526 | 725 |
| 203 | Amaranthus palmeri | PPOX_B10_4 | gDNA Contig | 526 | 725 |
| 204 | Amaranthus palmeri | PPOX_B10_5 | gDNA Contig | 701 | 900 |
| 205 | Amaranthus palmeri | PPOX_B10_5 | gDNA Contig | 701 | 900 |
| 206 | Amaranthus palmeri | PPOX_B10_6 | gDNA Contig | 876 | 1075 |
| 207 | Amaranthus palmeri | PPOX_B10_6 | gDNA Contig | 876 | 1075 |
| 208 | Amaranthus palmeri | PPOX_B10_7 | gDNA Contig | 1051 | 1250 |
| 209 | Amaranthus palmeri | PPOX_B10_7 | gDNA Contig | 1051 | 1250 |
| 210 | Amaranthus palmeri | PPOX_B10_8 | gDNA Contig | 1226 | 1425 |
| 211 | Amaranthus palmeri | PPOX_B10_8 | gDNA Contig | 1226 | 1425 |
| 212 | Amaranthus palmeri | PPOX_B10_9 | gDNA Contig | 1401 | 1600 |
| 213 | Amaranthus palmeri | PPOX_B10_9 | gDNA Contig | 1401 | 1600 |
| 214 | Amaranthus palmeri | PPOX_B10_10 | gDNA Contig | 1576 | 1775 |
| 215 | Amaranthus palmeri | PPOX_B10_10 | gDNA Contig | 1576 | 1775 |
| 216 | Amaranthus palmeri | PPOX_B10_11 | gDNA Contig | 1751 | 1950 |
| 217 | Amaranthus palmeri | PPOX_B10_11 | gDNA Contig | 1751 | 1950 |
| 218 | Amaranthus palmeri | PPOX_B10_12 | gDNA Contig | 1926 | 2125 |
| 219 | Amaranthus palmeri | PPOX_B10_12 | gDNA Contig | 1926 | 2125 |
| 220 | Amaranthus palmeri | PPOX_B10_13 | gDNA Contig | 2101 | 2300 |
| 221 | Amaranthus palmeri | PPOX_B10_13 | gDNA Contig | 2101 | 2300 |
| 222 | Amaranthus palmeri | PPOX_B10_14 | gDNA Contig | 2276 | 2475 |
| 223 | Amaranthus palmeri | PPOX_B10_14 | gDNA Contig | 2276 | 2475 |
| 224 | Amaranthus palmeri | PPOX_B10_15 | gDNA Contig | 2451 | 2650 |
| 225 | Amaranthus palmeri | PPOX_B10_15 | gDNA Contig | 2451 | 2650 |
| 226 | Amaranthus palmeri | PPOX_B10_16 | gDNA Contig | 2626 | 2825 |
| 227 | Amaranthus palmeri | PPOX_B10_16 | gDNA Contig | 2626 | 2825 |
| 228 | Amaranthus palmeri | PPOX_B10_17 | gDNA Contig | 2801 | 3000 |
| 229 | Amaranthus palmeri | PPOX_B10_17 | gDNA Contig | 2801 | 3000 |
| 230 | Amaranthus palmeri | PPOX_B10_18 | gDNA Contig | 2976 | 3175 |
| 231 | Amaranthus palmeri | PPOX_B10_18 | gDNA Contig | 2976 | 3175 |
| 232 | Amaranthus palmeri | PPOX_B10_19 | gDNA Contig | 3151 | 3350 |
| 233 | Amaranthus palmeri | PPOX_B10_19 | gDNA Contig | 3151 | 3350 |
| 234 | Amaranthus palmeri | PPOX_B10_20 | gDNA Contig | 3326 | 3525 |
| 235 | Amaranthus palmeri | PPOX_B10_20 | gDNA Contig | 3326 | 3525 |
| 236 | Amaranthus palmeri | PPOX_B10_21 | gDNA Contig | 3501 | 3700 |
| 237 | Amaranthus palmeri | PPOX_B10_21 | gDNA Contig | 3501 | 3700 |
| 238 | Amaranthus palmeri | PPOX_B10_22 | gDNA Contig | 3676 | 3875 |
| 239 | Amaranthus palmeri | PPOX_B10_22 | gDNA Contig | 3676 | 3875 |

TABLE 2-continued

| SEQ ID NO | Species | Name / Reference | Type | Start | End |
|---|---|---|---|---|---|
| 240 | Amaranthus palmeri | PPOX_B10_23 | gDNA Contig | 3851 | 4050 |
| 241 | Amaranthus palmeri | PPOX_B10_23 | gDNA Contig | 3851 | 4050 |
| 242 | Amaranthus palmeri | PPOX_B10_24 | gDNA Contig | 4026 | 4225 |
| 243 | Amaranthus palmeri | PPOX_B10_24 | gDNA Contig | 4026 | 4225 |
| 244 | Amaranthus palmeri | PPOX_B10_25 | gDNA Contig | 4201 | 4400 |
| 245 | Amaranthus palmeri | PPOX_B10_25 | gDNA Contig | 4201 | 4400 |
| 246 | Amaranthus palmeri | PPOX_B10_26 | gDNA Contig | 4376 | 4575 |
| 247 | Amaranthus palmeri | PPOX_B10_26 | gDNA Contig | 4376 | 4575 |
| 248 | Amaranthus palmeri | PPOX_B10_27 | gDNA Contig | 4551 | 4750 |
| 249 | Amaranthus palmeri | PPOX_B10_27 | gDNA Contig | 4551 | 4750 |
| 250 | Amaranthus palmeri | PPOX_B10_28 | gDNA Contig | 4726 | 4925 |
| 251 | Amaranthus palmeri | PPOX_B10_28 | gDNA Contig | 4726 | 4925 |
| 252 | Amaranthus palmeri | PPOX_B10_29 | gDNA Contig | 4901 | 5100 |
| 253 | Amaranthus palmeri | PPOX_B10_29 | gDNA Contig | 4901 | 5100 |
| 254 | Amaranthus palmeri | PPOX_B14_1 | gDNA Contig | 1 | 200 |
| 255 | Amaranthus palmeri | PPOX_B14_1 | gDNA Contig | 1 | 200 |
| 256 | Amaranthus palmeri | PPOX_B14_2 | gDNA Contig | 176 | 375 |
| 257 | Amaranthus palmeri | PPOX_B14_2 | gDNA Contig | 176 | 375 |
| 258 | Amaranthus palmeri | PPOX_B14_3 | gDNA Contig | 351 | 550 |
| 259 | Amaranthus palmeri | PPOX_B14_3 | gDNA Contig | 351 | 550 |
| 260 | Amaranthus palmeri | PPOX_B14_4 | gDNA Contig | 526 | 725 |
| 261 | Amaranthus palmeri | PPOX_B14_4 | gDNA Contig | 526 | 725 |
| 262 | Amaranthus palmeri | PPOX_B14_5 | gDNA Contig | 701 | 900 |
| 263 | Amaranthus palmeri | PPOX_B14_5 | gDNA Contig | 701 | 900 |
| 264 | Amaranthus palmeri | PPOX_B14_6 | gDNA Contig | 876 | 1075 |
| 265 | Amaranthus palmeri | PPOX_B14_6 | gDNA Contig | 876 | 1075 |
| 266 | Amaranthus palmeri | PPOX_B14_7 | gDNA Contig | 1051 | 1250 |
| 267 | Amaranthus palmeri | PPOX_B14_7 | gDNA Contig | 1051 | 1250 |
| 268 | Amaranthus palmeri | PPOX_B14_8 | gDNA Contig | 1226 | 1425 |
| 269 | Amaranthus palmeri | PPOX_B14_8 | gDNA Contig | 1226 | 1425 |
| 270 | Amaranthus palmeri | PPOX_B14_9 | gDNA Contig | 1401 | 1600 |
| 271 | Amaranthus palmeri | PPOX_B14_9 | gDNA Contig | 1401 | 1600 |
| 272 | Amaranthus palmeri | PPOX_B14_10 | gDNA Contig | 1576 | 1775 |
| 273 | Amaranthus palmeri | PPOX_B14_10 | gDNA Contig | 1576 | 1775 |
| 274 | Amaranthus palmeri | PPOX_B14_11 | gDNA Contig | 1751 | 1950 |
| 275 | Amaranthus palmeri | PPOX_B14_11 | gDNA Contig | 1751 | 1950 |
| 276 | Amaranthus palmeri | PPOX_B14_12 | gDNA Contig | 1926 | 2125 |
| 277 | Amaranthus palmeri | PPOX_B14_12 | gDNA Contig | 1926 | 2125 |
| 278 | Amaranthus palmeri | PPOX_B14_13 | gDNA Contig | 2101 | 2300 |
| 279 | Amaranthus palmeri | PPOX_B14_13 | gDNA Contig | 2101 | 2300 |
| 280 | Amaranthus palmeri | PPOX_B7_1 | cDNA Contig | 1 | 200 |
| 281 | Amaranthus palmeri | PPOX_B7_1 | cDNA Contig | 1 | 200 |
| 282 | Amaranthus palmeri | PPOX_B7_2 | cDNA Contig | 176 | 375 |
| 283 | Amaranthus palmeri | PPOX_B7_2 | cDNA Contig | 176 | 375 |
| 284 | Amaranthus palmeri | PPOX_B7_3 | cDNA Contig | 351 | 550 |
| 285 | Amaranthus palmeri | PPOX_B7_3 | cDNA Contig | 351 | 550 |
| 286 | Amaranthus palmeri | PPOX_B7_4 | cDNA Contig | 526 | 725 |
| 287 | Amaranthus palmeri | PPOX_B7_4 | cDNA Contig | 526 | 725 |
| 288 | Amaranthus palmeri | PPOX_B7_5 | cDNA Contig | 701 | 900 |
| 289 | Amaranthus palmeri | PPOX_B7_5 | cDNA Contig | 701 | 900 |
| 290 | Amaranthus palmeri | PPOX_B8_1 | cDNA Contig | 1 | 200 |
| 291 | Amaranthus palmeri | PPOX_B8_1 | cDNA Contig | 1 | 200 |
| 292 | Amaranthus palmeri | PPOX_B9_1 | gDNA Contig | 1 | 200 |
| 293 | Amaranthus palmeri | PPOX_B9_1 | gDNA Contig | 1 | 200 |
| 294 | Amaranthus palmeri | PPOX_B9_2 | gDNA Contig | 176 | 375 |
| 295 | Amaranthus palmeri | PPOX_B9_2 | gDNA Contig | 176 | 375 |
| 296 | Amaranthus palmeri | PPOX_B9_3 | gDNA Contig | 351 | 550 |
| 297 | Amaranthus palmeri | PPOX_B9_3 | gDNA Contig | 351 | 550 |
| 298 | Amaranthus palmeri | PPOX_B9_4 | gDNA Contig | 526 | 725 |
| 299 | Amaranthus palmeri | PPOX_B9_4 | gDNA Contig | 526 | 725 |
| 300 | Amaranthus palmeri | PPOX_B9_5 | gDNA Contig | 701 | 900 |
| 301 | Amaranthus palmeri | PPOX_B9_5 | gDNA Contig | 701 | 900 |
| 302 | Amaranthus palmeri | PPOX_B9_6 | gDNA Contig | 876 | 1075 |
| 303 | Amaranthus palmeri | PPOX_B9_6 | gDNA Contig | 876 | 1075 |
| 304 | Amaranthus palmeri | PPOX_B9_7 | gDNA Contig | 1051 | 1250 |
| 305 | Amaranthus palmeri | PPOX_B9_7 | gDNA Contig | 1051 | 1250 |
| 306 | Amaranthus palmeri | PPOX_B9_8 | gDNA Contig | 1226 | 1425 |
| 307 | Amaranthus palmeri | PPOX_B9_8 | gDNA Contig | 1226 | 1425 |
| 308 | Amaranthus palmeri | PPOX_B9_9 | gDNA Contig | 1401 | 1600 |
| 309 | Amaranthus palmeri | PPOX_B9_9 | gDNA Contig | 1401 | 1600 |
| 310 | Amaranthus palmeri | PPOX_B9_10 | gDNA Contig | 1576 | 1775 |
| 311 | Amaranthus palmeri | PPOX_B9_10 | gDNA Contig | 1576 | 1775 |
| 312 | Amaranthus palmeri | PPOX_B9_11 | gDNA Contig | 1751 | 1950 |
| 313 | Amaranthus palmeri | PPOX_B9_11 | gDNA Contig | 1751 | 1950 |
| 314 | Amaranthus palmeri | PPOX_B9_12 | gDNA Contig | 1926 | 2125 |
| 315 | Amaranthus palmeri | PPOX_B9_12 | gDNA Contig | 1926 | 2125 |
| 316 | Amaranthus palmeri | PPOX_B9_13 | gDNA Contig | 2101 | 2300 |

TABLE 2-continued

| SEQ ID NO | Species | Name | Reference | Type | Start | End |
|---|---|---|---|---|---|
| 317 | Amaranthus palmeri | PPOX_B9_13 | gDNA Contig | 2101 | 2300 |
| 318 | Amaranthus palmeri | PPOX_B9_14 | gDNA Contig | 2276 | 2475 |
| 319 | Amaranthus palmeri | PPOX_B9_14 | gDNA Contig | 2276 | 2475 |
| 320 | Amaranthus palmeri | PPOX_B9_15 | gDNA Contig | 2451 | 2650 |
| 321 | Amaranthus palmeri | PPOX_B9_15 | gDNA Contig | 2451 | 2650 |
| 322 | Amaranthus palmeri | PPOX_B9_16 | gDNA Contig | 2626 | 2825 |
| 323 | Amaranthus palmeri | PPOX_B9_16 | gDNA Contig | 2626 | 2825 |
| 324 | Amaranthus palmeri | PPOX_B9_17 | gDNA Contig | 2801 | 3000 |
| 325 | Amaranthus palmeri | PPOX_B9_17 | gDNA Contig | 2801 | 3000 |
| 326 | Amaranthus palmeri | PPOX_B9_18 | gDNA Contig | 2976 | 3175 |
| 327 | Amaranthus palmeri | PPOX_B9_18 | gDNA Contig | 2976 | 3175 |
| 328 | Amaranthus palmeri | PPOX_B9_19 | gDNA Contig | 3151 | 3350 |
| 329 | Amaranthus palmeri | PPOX_B9_19 | gDNA Contig | 3151 | 3350 |
| 330 | Amaranthus palmeri | PPOX_B9_20 | gDNA Contig | 3326 | 3525 |
| 331 | Amaranthus palmeri | PPOX_B9_20 | gDNA Contig | 3326 | 3525 |
| 332 | Amaranthus palmeri | PPOX_B9_21 | gDNA Contig | 3501 | 3700 |
| 333 | Amaranthus palmeri | PPOX_B9_21 | gDNA Contig | 3501 | 3700 |
| 334 | Amaranthus palmeri | PPOX_B9_22 | gDNA Contig | 3676 | 3875 |
| 335 | Amaranthus palmeri | PPOX_B9_22 | gDNA Contig | 3676 | 3875 |
| 336 | Amaranthus palmeri | PPOX_B9_23 | gDNA Contig | 3851 | 4050 |
| 337 | Amaranthus palmeri | PPOX_B9_23 | gDNA Contig | 3851 | 4050 |
| 338 | Amaranthus palmeri | PPOX_B9_24 | gDNA Contig | 4026 | 4225 |
| 339 | Amaranthus palmeri | PPOX_B9_24 | gDNA Contig | 4026 | 4225 |
| 340 | Amaranthus palmeri | PPOX_B9_25 | gDNA Contig | 4201 | 4400 |
| 341 | Amaranthus palmeri | PPOX_B9_25 | gDNA Contig | 4201 | 4400 |
| 342 | Amaranthus palmeri | PPOX_B9_26 | gDNA Contig | 4376 | 4575 |
| 343 | Amaranthus palmeri | PPOX_B9_26 | gDNA Contig | 4376 | 4575 |
| 344 | Amaranthus palmeri | PPOX_B9_27 | gDNA Contig | 4551 | 4750 |
| 345 | Amaranthus palmeri | PPOX_B9_27 | gDNA Contig | 4551 | 4750 |
| 346 | Amaranthus palmeri | PPOX_B9_28 | gDNA Contig | 4726 | 4925 |
| 347 | Amaranthus palmeri | PPOX_B9_28 | gDNA Contig | 4726 | 4925 |
| 348 | Amaranthus palmeri | PPOX_B9_29 | gDNA Contig | 4901 | 5100 |
| 349 | Amaranthus palmeri | PPOX_B9_29 | gDNA Contig | 4901 | 5100 |
| 350 | Amaranthus palmeri | PPOX_B9_30 | gDNA Contig | 5076 | 5275 |
| 351 | Amaranthus palmeri | PPOX_B9_30 | gDNA Contig | 5076 | 5275 |
| 352 | Amaranthus palmeri | PPOX_B9_31 | gDNA Contig | 5251 | 5450 |
| 353 | Amaranthus palmeri | PPOX_B9_31 | gDNA Contig | 5251 | 5450 |
| 354 | Amaranthus palmeri | PPOX_B9_32 | gDNA Contig | 5426 | 5625 |
| 355 | Amaranthus palmeri | PPOX_B9_32 | gDNA Contig | 5426 | 5625 |
| 356 | Amaranthus palmeri | PPOX_B9_33 | gDNA Contig | 5601 | 5800 |
| 357 | Amaranthus palmeri | PPOX_B9_33 | gDNA Contig | 5601 | 5800 |
| 358 | Amaranthus palmeri | PPOX_B9_34 | gDNA Contig | 5776 | 5975 |
| 359 | Amaranthus palmeri | PPOX_B9_34 | gDNA Contig | 5776 | 5975 |
| 360 | Amaranthus palmeri | PPOX_B9_35 | gDNA Contig | 5951 | 6150 |
| 361 | Amaranthus palmeri | PPOX_B9_35 | gDNA Contig | 5951 | 6150 |
| 362 | Amaranthus palmeri | PPOX_B9_36 | gDNA Contig | 6126 | 6325 |
| 363 | Amaranthus palmeri | PPOX_B9_36 | gDNA Contig | 6126 | 6325 |
| 364 | Amaranthus palmeri | PPOX_B12_1 | gDNA Contig | 1 | 200 |
| 365 | Amaranthus palmeri | PPOX_B12_1 | gDNA Contig | 1 | 200 |
| 366 | Amaranthus palmeri | PPOX_B12_2 | gDNA Contig | 176 | 375 |
| 367 | Amaranthus palmeri | PPOX_B12_2 | gDNA Contig | 176 | 375 |
| 368 | Amaranthus palmeri | PPOX_B12_3 | gDNA Contig | 351 | 550 |
| 369 | Amaranthus palmeri | PPOX_B12_3 | gDNA Contig | 351 | 550 |
| 370 | Amaranthus palmeri | PPOX_B12_4 | gDNA Contig | 526 | 725 |
| 371 | Amaranthus palmeri | PPOX_B12_4 | gDNA Contig | 526 | 725 |
| 372 | Amaranthus palmeri | PPOX_B12_5 | gDNA Contig | 701 | 900 |
| 373 | Amaranthus palmeri | PPOX_B12_5 | gDNA Contig | 701 | 900 |
| 374 | Amaranthus palmeri | PPOX_B12_6 | gDNA Contig | 876 | 1075 |
| 375 | Amaranthus palmeri | PPOX_B12_6 | gDNA Contig | 876 | 1075 |
| 376 | Amaranthus palmeri | PPOX_B12_7 | gDNA Contig | 1051 | 1250 |
| 377 | Amaranthus palmeri | PPOX_B12_7 | gDNA Contig | 1051 | 1250 |
| 378 | Amaranthus palmeri | PPOX_B12_8 | gDNA Contig | 1226 | 1425 |
| 379 | Amaranthus palmeri | PPOX_B12_8 | gDNA Contig | 1226 | 1425 |
| 380 | Amaranthus palmeri | PPOX_B12_9 | gDNA Contig | 1401 | 1600 |
| 381 | Amaranthus palmeri | PPOX_B12_9 | gDNA Contig | 1401 | 1600 |
| 382 | Amaranthus palmeri | PPOX_B12_10 | gDNA Contig | 1576 | 1775 |
| 383 | Amaranthus palmeri | PPOX_B12_10 | gDNA Contig | 1576 | 1775 |
| 384 | Amaranthus palmeri | PPOX_B15_1 | gDNA Contig | 1 | 200 |
| 385 | Amaranthus palmeri | PPOX_B15_1 | gDNA Contig | 1 | 200 |
| 386 | Amaranthus palmeri | PPOX_B15_2 | gDNA Contig | 176 | 375 |
| 387 | Amaranthus palmeri | PPOX_B15_2 | gDNA Contig | 176 | 375 |
| 388 | Amaranthus palmeri | PPOX_B15_3 | gDNA Contig | 351 | 550 |
| 389 | Amaranthus palmeri | PPOX_B15_3 | gDNA Contig | 351 | 550 |
| 390 | Amaranthus palmeri | PPOX_B15_4 | gDNA Contig | 526 | 725 |
| 391 | Amaranthus palmeri | PPOX_B15_4 | gDNA Contig | 526 | 725 |
| 392 | Amaranthus palmeri | PPOX_B11_1 | gDNA Contig | 1 | 200 |
| 393 | Amaranthus palmeri | PPOX_B11_1 | gDNA Contig | 1 | 200 |

TABLE 2-continued

| SEQ ID NO | Species | Name | Reference | Type | Start | End |
|---|---|---|---|---|---|
| 394 | Amaranthus palmeri | PPOX_B11_2 | gDNA Contig | 176 | 375 |
| 395 | Amaranthus palmeri | PPOX_B11_2 | gDNA Contig | 176 | 375 |
| 396 | Amaranthus palmeri | PPOX_B11_3 | gDNA Contig | 351 | 550 |
| 397 | Amaranthus palmeri | PPOX_B11_3 | gDNA Contig | 351 | 550 |
| 398 | Amaranthus palmeri | PPOX_B11_4 | gDNA Contig | 526 | 725 |
| 399 | Amaranthus palmeri | PPOX_B11_4 | gDNA Contig | 526 | 725 |
| 400 | Amaranthus palmeri | PPOX_B11_5 | gDNA Contig | 701 | 900 |
| 401 | Amaranthus palmeri | PPOX_B11_5 | gDNA Contig | 701 | 900 |
| 402 | Amaranthus palmeri | PPOX_B11_6 | gDNA Contig | 876 | 1075 |
| 403 | Amaranthus palmeri | PPOX_B11_6 | gDNA Contig | 876 | 1075 |
| 404 | Amaranthus palmeri | PPOX_B11_7 | gDNA Contig | 1051 | 1250 |
| 405 | Amaranthus palmeri | PPOX_B11_7 | gDNA Contig | 1051 | 1250 |
| 406 | Amaranthus palmeri | PPOX_B11_8 | gDNA Contig | 1226 | 1425 |
| 407 | Amaranthus palmeri | PPOX_B11_8 | gDNA Contig | 1226 | 1425 |
| 408 | Amaranthus palmeri | PPOX_B11_9 | gDNA Contig | 1401 | 1600 |
| 409 | Amaranthus palmeri | PPOX_B11_9 | gDNA Contig | 1401 | 1600 |
| 410 | Amaranthus palmeri | PPOX_B11_10 | gDNA Contig | 1576 | 1775 |
| 411 | Amaranthus palmeri | PPOX_B11_10 | gDNA Contig | 1576 | 1775 |
| 412 | Amaranthus palmeri | PPOX_B11_11 | gDNA Contig | 1751 | 1950 |
| 413 | Amaranthus palmeri | PPOX_B11_11 | gDNA Contig | 1751 | 1950 |
| 414 | Amaranthus palmeri | PPOX_B11_12 | gDNA Contig | 1926 | 2125 |
| 415 | Amaranthus palmeri | PPOX_B11_12 | gDNA Contig | 1926 | 2125 |
| 416 | Amaranthus palmeri | PPOX_B11_13 | gDNA Contig | 2101 | 2300 |
| 417 | Amaranthus palmeri | PPOX_B11_13 | gDNA Contig | 2101 | 2300 |
| 418 | Amaranthus palmeri | PPOX_B11_14 | gDNA Contig | 2276 | 2475 |
| 419 | Amaranthus palmeri | PPOX_B11_14 | gDNA Contig | 2276 | 2475 |
| 420 | Amaranthus palmeri | PPOX_B11_15 | gDNA Contig | 2451 | 2650 |
| 421 | Amaranthus palmeri | PPOX_B11_15 | gDNA Contig | 2451 | 2650 |
| 422 | Amaranthus palmeri | PPOX_B11_16 | gDNA Contig | 2626 | 2825 |
| 423 | Amaranthus palmeri | PPOX_B11_16 | gDNA Contig | 2626 | 2825 |
| 424 | Amaranthus rudis | PPOX_B24_1 | gDNA Contig | 1 | 200 |
| 425 | Amaranthus rudis | PPOX_B24_1 | gDNA Contig | 1 | 200 |
| 426 | Amaranthus rudis | PPOX_B24_2 | gDNA Contig | 176 | 375 |
| 427 | Amaranthus rudis | PPOX_B24_2 | gDNA Contig | 176 | 375 |
| 428 | Amaranthus rudis | PPOX_B24_3 | gDNA Contig | 351 | 550 |
| 429 | Amaranthus rudis | PPOX_B24_3 | gDNA Contig | 351 | 550 |
| 430 | Amaranthus rudis | PPOX_B22_1 | gDNA Contig | 1 | 200 |
| 431 | Amaranthus rudis | PPOX_B22_1 | gDNA Contig | 1 | 200 |
| 432 | Amaranthus rudis | PPOX_B22_2 | gDNA Contig | 176 | 375 |
| 433 | Amaranthus rudis | PPOX_B22_2 | gDNA Contig | 176 | 375 |
| 434 | Amaranthus rudis | PPOX_B22_3 | gDNA Contig | 351 | 550 |
| 435 | Amaranthus rudis | PPOX_B22_3 | gDNA Contig | 351 | 550 |
| 436 | Amaranthus rudis | PPOX_B22_4 | gDNA Contig | 526 | 725 |
| 437 | Amaranthus rudis | PPOX_B22_4 | gDNA Contig | 526 | 725 |
| 438 | Amaranthus rudis | PPOX_B22_5 | gDNA Contig | 701 | 900 |
| 439 | Amaranthus rudis | PPOX_B22_5 | gDNA Contig | 701 | 900 |
| 440 | Amaranthus rudis | PPOX_B17_1 | cDNA Contig | 1 | 200 |
| 441 | Amaranthus rudis | PPOX_B17_1 | cDNA Contig | 1 | 200 |
| 442 | Amaranthus rudis | PPOX_B17_2 | cDNA Contig | 176 | 375 |
| 443 | Amaranthus rudis | PPOX_B17_2 | cDNA Contig | 176 | 375 |
| 444 | Amaranthus rudis | PPOX_B17_3 | cDNA Contig | 351 | 550 |
| 445 | Amaranthus rudis | PPOX_B17_3 | cDNA Contig | 351 | 550 |
| 446 | Amaranthus rudis | PPOX_B17_4 | cDNA Contig | 526 | 725 |
| 447 | Amaranthus rudis | PPOX_B17_4 | cDNA Contig | 526 | 725 |
| 448 | Amaranthus rudis | PPOX_B17_5 | cDNA Contig | 701 | 900 |
| 449 | Amaranthus rudis | PPOX_B17_5 | cDNA Contig | 701 | 900 |
| 450 | Amaranthus rudis | PPOX_B17_6 | cDNA Contig | 876 | 1075 |
| 451 | Amaranthus rudis | PPOX_B17_6 | cDNA Contig | 876 | 1075 |
| 452 | Amaranthus rudis | PPOX_B17_7 | cDNA Contig | 1051 | 1250 |
| 453 | Amaranthus rudis | PPOX_B17_7 | cDNA Contig | 1051 | 1250 |
| 454 | Amaranthus rudis | PPOX_B17_8 | cDNA Contig | 1226 | 1425 |
| 455 | Amaranthus rudis | PPOX_B17_8 | cDNA Contig | 1226 | 1425 |
| 456 | Amaranthus rudis | PPOX_B17_9 | cDNA Contig | 1401 | 1600 |
| 457 | Amaranthus rudis | PPOX_B17_9 | cDNA Contig | 1401 | 1600 |
| 458 | Amaranthus rudis | PPOX_B20_1 | gDNA Contig | 1 | 200 |
| 459 | Amaranthus rudis | PPOX_B20_1 | gDNA Contig | 1 | 200 |
| 460 | Amaranthus rudis | PPOX_B20_2 | gDNA Contig | 176 | 375 |
| 461 | Amaranthus rudis | PPOX_B20_2 | gDNA Contig | 176 | 375 |
| 462 | Amaranthus rudis | PPOX_B20_3 | gDNA Contig | 351 | 550 |
| 463 | Amaranthus rudis | PPOX_B20_3 | gDNA Contig | 351 | 550 |
| 464 | Amaranthus rudis | PPOX_B20_4 | gDNA Contig | 526 | 725 |
| 465 | Amaranthus rudis | PPOX_B20_4 | gDNA Contig | 526 | 725 |
| 466 | Amaranthus rudis | PPOX_B20_5 | gDNA Contig | 701 | 900 |
| 467 | Amaranthus rudis | PPOX_B20_5 | gDNA Contig | 701 | 900 |
| 468 | Amaranthus rudis | PPOX_B20_6 | gDNA Contig | 876 | 1075 |
| 469 | Amaranthus rudis | PPOX_B20_6 | gDNA Contig | 876 | 1075 |
| 470 | Amaranthus rudis | PPOX_B20_7 | gDNA Contig | 1051 | 1250 |

TABLE 2-continued

| SEQ ID NO | Species | Name / Reference | Type | Start | End |
|---|---|---|---|---|---|
| 471 | Amaranthus rudis | PPOX_B20_7 | gDNA Contig | 1051 | 1250 |
| 472 | Amaranthus rudis | PPOX_B20_8 | gDNA Contig | 1226 | 1425 |
| 473 | Amaranthus rudis | PPOX_B20_8 | gDNA Contig | 1226 | 1425 |
| 474 | Amaranthus rudis | PPOX_B20_9 | gDNA Contig | 1401 | 1600 |
| 475 | Amaranthus rudis | PPOX_B20_9 | gDNA Contig | 1401 | 1600 |
| 476 | Amaranthus rudis | PPOX_B20_10 | gDNA Contig | 1576 | 1775 |
| 477 | Amaranthus rudis | PPOX_B20_10 | gDNA Contig | 1576 | 1775 |
| 478 | Amaranthus rudis | PPOX_B20_11 | gDNA Contig | 1751 | 1950 |
| 479 | Amaranthus rudis | PPOX_B20_11 | gDNA Contig | 1751 | 1950 |
| 480 | Amaranthus rudis | PPOX_B20_12 | gDNA Contig | 1926 | 2125 |
| 481 | Amaranthus rudis | PPOX_B20_12 | gDNA Contig | 1926 | 2125 |
| 482 | Amaranthus rudis | PPOX_B20_13 | gDNA Contig | 2101 | 2300 |
| 483 | Amaranthus rudis | PPOX_B20_13 | gDNA Contig | 2101 | 2300 |
| 484 | Amaranthus rudis | PPOX_B20_14 | gDNA Contig | 2276 | 2475 |
| 485 | Amaranthus rudis | PPOX_B20_14 | gDNA Contig | 2276 | 2475 |
| 486 | Amaranthus rudis | PPOX_B20_15 | gDNA Contig | 2451 | 2650 |
| 487 | Amaranthus rudis | PPOX_B20_15 | gDNA Contig | 2451 | 2650 |
| 488 | Amaranthus rudis | PPOX_B20_16 | gDNA Contig | 2626 | 2825 |
| 489 | Amaranthus rudis | PPOX_B20_16 | gDNA Contig | 2626 | 2825 |
| 490 | Amaranthus rudis | PPOX_B20_17 | gDNA Contig | 2801 | 3000 |
| 491 | Amaranthus rudis | PPOX_B20_17 | gDNA Contig | 2801 | 3000 |
| 492 | Amaranthus rudis | PPOX_B20_18 | gDNA Contig | 2976 | 3175 |
| 493 | Amaranthus rudis | PPOX_B20_18 | gDNA Contig | 2976 | 3175 |
| 494 | Amaranthus rudis | PPOX_B20_19 | gDNA Contig | 3151 | 3350 |
| 495 | Amaranthus rudis | PPOX_B20_19 | gDNA Contig | 3151 | 3350 |
| 496 | Amaranthus rudis | PPOX_B20_20 | gDNA Contig | 3326 | 3525 |
| 497 | Amaranthus rudis | PPOX_B20_20 | gDNA Contig | 3326 | 3525 |
| 498 | Amaranthus rudis | PPOX_B20_21 | gDNA Contig | 3501 | 3700 |
| 499 | Amaranthus rudis | PPOX_B20_21 | gDNA Contig | 3501 | 3700 |
| 500 | Amaranthus rudis | PPOX_B20_22 | gDNA Contig | 3676 | 3875 |
| 501 | Amaranthus rudis | PPOX_B20_22 | gDNA Contig | 3676 | 3875 |
| 502 | Amaranthus rudis | PPOX_B20_23 | gDNA Contig | 3851 | 4050 |
| 503 | Amaranthus rudis | PPOX_B20_23 | gDNA Contig | 3851 | 4050 |
| 504 | Amaranthus rudis | PPOX_B20_24 | gDNA Contig | 4026 | 4225 |
| 505 | Amaranthus rudis | PPOX_B20_24 | gDNA Contig | 4026 | 4225 |
| 506 | Amaranthus rudis | PPOX_B20_25 | gDNA Contig | 4201 | 4400 |
| 507 | Amaranthus rudis | PPOX_B20_25 | gDNA Contig | 4201 | 4400 |
| 508 | Amaranthus rudis | PPOX_B20_26 | gDNA Contig | 4376 | 4575 |
| 509 | Amaranthus rudis | PPOX_B20_26 | gDNA Contig | 4376 | 4575 |
| 510 | Amaranthus rudis | PPOX_B20_27 | gDNA Contig | 4551 | 4750 |
| 511 | Amaranthus rudis | PPOX_B20_27 | gDNA Contig | 4551 | 4750 |
| 512 | Amaranthus rudis | PPOX_B20_28 | gDNA Contig | 4726 | 4925 |
| 513 | Amaranthus rudis | PPOX_B20_28 | gDNA Contig | 4726 | 4925 |
| 514 | Amaranthus rudis | PPOX_B20_29 | gDNA Contig | 4901 | 5100 |
| 515 | Amaranthus rudis | PPOX_B20_29 | gDNA Contig | 4901 | 5100 |
| 516 | Amaranthus rudis | PPOX_B20_30 | gDNA Contig | 5076 | 5275 |
| 517 | Amaranthus rudis | PPOX_B20_30 | gDNA Contig | 5076 | 5275 |
| 518 | Amaranthus rudis | PPOX_B20_31 | gDNA Contig | 5251 | 5450 |
| 519 | Amaranthus rudis | PPOX_B20_31 | gDNA Contig | 5251 | 5450 |
| 520 | Amaranthus rudis | PPOX_B20_32 | gDNA Contig | 5426 | 5625 |
| 521 | Amaranthus rudis | PPOX_B20_32 | gDNA Contig | 5426 | 5625 |
| 522 | Amaranthus rudis | PPOX_B18_1 | cDNA Contig | 1 | 200 |
| 523 | Amaranthus rudis | PPOX_B18_1 | cDNA Contig | 1 | 200 |
| 524 | Amaranthus rudis | PPOX_B18_2 | cDNA Contig | 176 | 375 |
| 525 | Amaranthus rudis | PPOX_B18_2 | cDNA Contig | 176 | 375 |
| 526 | Amaranthus rudis | PPOX_B18_3 | cDNA Contig | 351 | 550 |
| 527 | Amaranthus rudis | PPOX_B18_3 | cDNA Contig | 351 | 550 |
| 528 | Amaranthus rudis | PPOX_B18_4 | cDNA Contig | 526 | 725 |
| 529 | Amaranthus rudis | PPOX_B18_4 | cDNA Contig | 526 | 725 |
| 530 | Amaranthus rudis | PPOX_B18_5 | cDNA Contig | 701 | 900 |
| 531 | Amaranthus rudis | PPOX_B18_5 | cDNA Contig | 701 | 900 |
| 532 | Amaranthus rudis | PPOX_B18_6 | cDNA Contig | 876 | 1075 |
| 533 | Amaranthus rudis | PPOX_B18_6 | cDNA Contig | 876 | 1075 |
| 534 | Amaranthus rudis | PPOX_B16_1 | cDNA Contig | 1 | 200 |
| 535 | Amaranthus rudis | PPOX_B16_1 | cDNA Contig | 1 | 200 |
| 536 | Amaranthus rudis | PPOX_B16_2 | cDNA Contig | 176 | 375 |
| 537 | Amaranthus rudis | PPOX_B16_2 | cDNA Contig | 176 | 375 |
| 538 | Amaranthus rudis | PPOX_B16_3 | cDNA Contig | 351 | 550 |
| 539 | Amaranthus rudis | PPOX_B16_3 | cDNA Contig | 351 | 550 |
| 540 | Amaranthus rudis | PPOX_B16_4 | cDNA Contig | 526 | 725 |
| 541 | Amaranthus rudis | PPOX_B16_4 | cDNA Contig | 526 | 725 |
| 542 | Amaranthus rudis | PPOX_B16_5 | cDNA Contig | 701 | 900 |
| 543 | Amaranthus rudis | PPOX_B16_5 | cDNA Contig | 701 | 900 |
| 544 | Amaranthus rudis | PPOX_B16_6 | cDNA Contig | 876 | 1075 |
| 545 | Amaranthus rudis | PPOX_B16_6 | cDNA Contig | 876 | 1075 |
| 546 | Amaranthus rudis | PPOX_B16_7 | cDNA Contig | 1051 | 1250 |
| 547 | Amaranthus rudis | PPOX_B16_7 | cDNA Contig | 1051 | 1250 |

TABLE 2-continued

| SEQ ID NO | Species | Name / Reference | Type | Start | End |
|---|---|---|---|---|---|
| 548 | Amaranthus rudis | PPOX_B16_8 | cDNA Contig | 1226 | 1425 |
| 549 | Amaranthus rudis | PPOX_B16_8 | cDNA Contig | 1226 | 1425 |
| 550 | Amaranthus rudis | PPOX_B16_9 | cDNA Contig | 1401 | 1600 |
| 551 | Amaranthus rudis | PPOX_B16_9 | cDNA Contig | 1401 | 1600 |
| 552 | Amaranthus rudis | PPOX_B16_10 | cDNA Contig | 1576 | 1775 |
| 553 | Amaranthus rudis | PPOX_B16_10 | cDNA Contig | 1576 | 1775 |
| 554 | Amaranthus rudis | PPOX_B19_1 | cDNA Contig | 1 | 200 |
| 555 | Amaranthus rudis | PPOX_B19_1 | cDNA Contig | 1 | 200 |
| 556 | Amaranthus rudis | PPOX_B19_2 | cDNA Contig | 176 | 375 |
| 557 | Amaranthus rudis | PPOX_B19_2 | cDNA Contig | 176 | 375 |
| 558 | Amaranthus rudis | PPOX_B19_3 | cDNA Contig | 351 | 550 |
| 559 | Amaranthus rudis | PPOX_B19_3 | cDNA Contig | 351 | 550 |
| 560 | Amaranthus rudis | PPOX_B23_1 | gDNA Contig | 1 | 200 |
| 561 | Amaranthus rudis | PPOX_B23_1 | gDNA Contig | 1 | 200 |
| 562 | Amaranthus rudis | PPOX_B23_2 | gDNA Contig | 351 | 550 |
| 563 | Amaranthus rudis | PPOX_B23_2 | gDNA Contig | 351 | 550 |
| 564 | Amaranthus rudis | PPOX_B25_1 | gDNA Contig | 1 | 200 |
| 565 | Amaranthus rudis | PPOX_B25_1 | gDNA Contig | 1 | 200 |
| 566 | Amaranthus rudis | PPOX_B25_2 | gDNA Contig | 176 | 375 |
| 567 | Amaranthus rudis | PPOX_B25_2 | gDNA Contig | 176 | 375 |
| 568 | Amaranthus rudis | PPOX_B21_1 | gDNA Contig | 1 | 200 |
| 569 | Amaranthus rudis | PPOX_B21_1 | gDNA Contig | 1 | 200 |
| 570 | Amaranthus rudis | PPOX_B21_2 | gDNA Contig | 176 | 375 |
| 571 | Amaranthus rudis | PPOX_B21_2 | gDNA Contig | 176 | 375 |
| 572 | Amaranthus rudis | PPOX_B21_3 | gDNA Contig | 351 | 550 |
| 573 | Amaranthus rudis | PPOX_B21_3 | gDNA Contig | 351 | 550 |
| 574 | Amaranthus rudis | PPOX_B21_4 | gDNA Contig | 526 | 725 |
| 575 | Amaranthus rudis | PPOX_B21_4 | gDNA Contig | 526 | 725 |
| 576 | Amaranthus rudis | PPOX_B21_5 | gDNA Contig | 701 | 900 |
| 577 | Amaranthus rudis | PPOX_B21_5 | gDNA Contig | 701 | 900 |
| 578 | Amaranthus spinosus | PPOX_B26_1 | cDNA Contig | 1 | 200 |
| 579 | Amaranthus spinosus | PPOX_B26_1 | cDNA Contig | 1 | 200 |
| 580 | Amaranthus spinosus | PPOX_B26_2 | cDNA Contig | 176 | 375 |
| 581 | Amaranthus spinosus | PPOX_B26_2 | cDNA Contig | 176 | 375 |
| 582 | Amaranthus spinosus | PPOX_B26_3 | cDNA Contig | 351 | 550 |
| 583 | Amaranthus spinosus | PPOX_B26_3 | cDNA Contig | 351 | 550 |
| 584 | Amaranthus spinosus | PPOX_B26_4 | cDNA Contig | 526 | 725 |
| 585 | Amaranthus spinosus | PPOX_B26_4 | cDNA Contig | 526 | 725 |
| 586 | Amaranthus spinosus | PPOX_B26_5 | cDNA Contig | 701 | 900 |
| 587 | Amaranthus spinosus | PPOX_B26_5 | cDNA Contig | 701 | 900 |
| 588 | Amaranthus spinosus | PPOX_B26_6 | cDNA Contig | 876 | 1075 |
| 589 | Amaranthus spinosus | PPOX_B26_6 | cDNA Contig | 876 | 1075 |
| 590 | Amaranthus spinosus | PPOX_B26_7 | cDNA Contig | 1051 | 1250 |
| 591 | Amaranthus spinosus | PPOX_B26_7 | cDNA Contig | 1051 | 1250 |
| 592 | Amaranthus spinosus | PPOX_B26_8 | cDNA Contig | 1226 | 1425 |
| 593 | Amaranthus spinosus | PPOX_B26_8 | cDNA Contig | 1226 | 1425 |
| 594 | Amaranthus thunbergii | PPOX_B27_1 | cDNA Contig | 1 | 200 |
| 595 | Amaranthus thunbergii | PPOX_B27_1 | cDNA Contig | 1 | 200 |
| 596 | Amaranthus thunbergii | PPOX_B27_2 | cDNA Contig | 176 | 375 |
| 597 | Amaranthus thunbergii | PPOX_B27_2 | cDNA Contig | 176 | 375 |
| 598 | Amaranthus thunbergii | PPOX_B27_3 | cDNA Contig | 351 | 550 |
| 599 | Amaranthus thunbergii | PPOX_B27_3 | cDNA Contig | 351 | 550 |
| 600 | Amaranthus thunbergii | PPOX_B27_4 | cDNA Contig | 526 | 725 |
| 601 | Amaranthus thunbergii | PPOX_B27_4 | cDNA Contig | 526 | 725 |
| 602 | Amaranthus thunbergii | PPOX_B27_5 | cDNA Contig | 701 | 900 |
| 603 | Amaranthus thunbergii | PPOX_B27_5 | cDNA Contig | 701 | 900 |
| 604 | Amaranthus thunbergii | PPOX_B27_6 | cDNA Contig | 876 | 1075 |
| 605 | Amaranthus thunbergii | PPOX_B27_6 | cDNA Contig | 876 | 1075 |
| 606 | Amaranthus thunbergii | PPOX_B27_7 | cDNA Contig | 1051 | 1250 |
| 607 | Amaranthus thunbergii | PPOX_B27_7 | cDNA Contig | 1051 | 1250 |
| 608 | Amaranthus thunbergii | PPOX_B27_8 | cDNA Contig | 1226 | 1425 |
| 609 | Amaranthus thunbergii | PPOX_B27_8 | cDNA Contig | 1226 | 1425 |
| 610 | Amaranthus viridis | PPOX_B28_1 | cDNA Contig | 1 | 200 |
| 611 | Amaranthus viridis | PPOX_B28_1 | cDNA Contig | 1 | 200 |
| 612 | Amaranthus viridis | PPOX_B28_2 | cDNA Contig | 176 | 375 |
| 613 | Amaranthus viridis | PPOX_B28_2 | cDNA Contig | 176 | 375 |
| 614 | Amaranthus viridis | PPOX_B28_3 | cDNA Contig | 351 | 550 |
| 615 | Amaranthus viridis | PPOX_B28_3 | cDNA Contig | 351 | 550 |
| 616 | Amaranthus viridis | PPOX_B28_4 | cDNA Contig | 526 | 725 |
| 617 | Amaranthus viridis | PPOX_B28_4 | cDNA Contig | 526 | 725 |
| 618 | Amaranthus viridis | PPOX_B28_5 | cDNA Contig | 701 | 900 |
| 619 | Amaranthus viridis | PPOX_B28_5 | cDNA Contig | 701 | 900 |
| 620 | Amaranthus viridis | PPOX_B28_6 | cDNA Contig | 876 | 1075 |
| 621 | Amaranthus viridis | PPOX_B28_6 | cDNA Contig | 876 | 1075 |
| 622 | Amaranthus viridis | PPOX_B28_7 | cDNA Contig | 1051 | 1250 |
| 623 | Amaranthus viridis | PPOX_B28_7 | cDNA Contig | 1051 | 1250 |
| 624 | Amaranthus viridis | PPOX_B28_8 | cDNA Contig | 1226 | 1425 |

TABLE 2-continued

| SEQ ID NO | Species | Name | Reference | Type | Start | End |
|---|---|---|---|---|---|
| 625 | Amaranthus viridis | PPOX_B28_8 | cDNA Contig | 1226 | 1425 |
| 626 | Amaranthus viridis | PPOX_B28_9 | cDNA Contig | 1401 | 1600 |
| 627 | Amaranthus viridis | PPOX_B28_9 | cDNA Contig | 1401 | 1600 |
| 628 | Amaranthus viridis | PPOX_B28_10 | cDNA Contig | 1576 | 1775 |
| 629 | Amaranthus viridis | PPOX_B28_10 | cDNA Contig | 1576 | 1775 |
| 630 | Ambrosia trifida | PPOX_B34_1 | gDNA Contig | 1 | 200 |
| 631 | Ambrosia trifida | PPOX_B34_1 | gDNA Contig | 1 | 200 |
| 632 | Ambrosia trifida | PPOX_B34_2 | gDNA Contig | 176 | 375 |
| 633 | Ambrosia trifida | PPOX_B34_2 | gDNA Contig | 176 | 375 |
| 634 | Ambrosia trifida | PPOX_B32_1 | gDNA Contig | 1 | 200 |
| 635 | Ambrosia trifida | PPOX_B32_1 | gDNA Contig | 1 | 200 |
| 636 | Ambrosia trifida | PPOX_B32_2 | gDNA Contig | 176 | 375 |
| 637 | Ambrosia trifida | PPOX_B32_2 | gDNA Contig | 176 | 375 |
| 638 | Ambrosia trifida | PPOX_B32_3 | gDNA Contig | 351 | 550 |
| 639 | Ambrosia trifida | PPOX_B32_3 | gDNA Contig | 351 | 550 |
| 640 | Ambrosia trifida | PPOX_B32_4 | gDNA Contig | 526 | 725 |
| 641 | Ambrosia trifida | PPOX_B32_4 | gDNA Contig | 526 | 725 |
| 642 | Ambrosia trifida | PPOX_B32_5 | gDNA Contig | 701 | 900 |
| 643 | Ambrosia trifida | PPOX_B32_5 | gDNA Contig | 701 | 900 |
| 644 | Ambrosia trifida | PPOX_B32_6 | gDNA Contig | 876 | 1075 |
| 645 | Ambrosia trifida | PPOX_B32_6 | gDNA Contig | 876 | 1075 |
| 646 | Ambrosia trifida | PPOX_B32_7 | gDNA Contig | 1051 | 1250 |
| 647 | Ambrosia trifida | PPOX_B32_7 | gDNA Contig | 1051 | 1250 |
| 648 | Ambrosia trifida | PPOX_B32_8 | gDNA Contig | 1226 | 1425 |
| 649 | Ambrosia trifida | PPOX_B32_8 | gDNA Contig | 1226 | 1425 |
| 650 | Ambrosia trifida | PPOX_B32_9 | gDNA Contig | 1401 | 1600 |
| 651 | Ambrosia trifida | PPOX_B32_9 | gDNA Contig | 1401 | 1600 |
| 652 | Ambrosia trifida | PPOX_B32_10 | gDNA Contig | 1576 | 1775 |
| 653 | Ambrosia trifida | PPOX_B32_10 | gDNA Contig | 1576 | 1775 |
| 654 | Ambrosia trifida | PPOX_B32_11 | gDNA Contig | 1751 | 1950 |
| 655 | Ambrosia trifida | PPOX_B32_11 | gDNA Contig | 1751 | 1950 |
| 656 | Ambrosia trifida | PPOX_B32_12 | gDNA Contig | 1926 | 2125 |
| 657 | Ambrosia trifida | PPOX_B32_12 | gDNA Contig | 1926 | 2125 |
| 658 | Ambrosia trifida | PPOX_B32_13 | gDNA Contig | 2101 | 2300 |
| 659 | Ambrosia trifida | PPOX_B32_13 | gDNA Contig | 2101 | 2300 |
| 660 | Ambrosia trifida | PPOX_B32_14 | gDNA Contig | 2276 | 2475 |
| 661 | Ambrosia trifida | PPOX_B32_14 | gDNA Contig | 2276 | 2475 |
| 662 | Ambrosia trifida | PPOX_B32_15 | gDNA Contig | 2451 | 2650 |
| 663 | Ambrosia trifida | PPOX_B32_15 | gDNA Contig | 2451 | 2650 |
| 664 | Ambrosia trifida | PPOX_B32_16 | gDNA Contig | 2626 | 2825 |
| 665 | Ambrosia trifida | PPOX_B32_16 | gDNA Contig | 2626 | 2825 |
| 666 | Ambrosia trifida | PPOX_B32_17 | gDNA Contig | 2801 | 3000 |
| 667 | Ambrosia trifida | PPOX_B32_17 | gDNA Contig | 2801 | 3000 |
| 668 | Ambrosia trifida | PPOX_B32_18 | gDNA Contig | 2976 | 3175 |
| 669 | Ambrosia trifida | PPOX_B32_18 | gDNA Contig | 2976 | 3175 |
| 670 | Ambrosia trifida | PPOX_B32_19 | gDNA Contig | 3151 | 3350 |
| 671 | Ambrosia trifida | PPOX_B32_19 | gDNA Contig | 3151 | 3350 |
| 672 | Ambrosia trifida | PPOX_B32_20 | gDNA Contig | 3326 | 3525 |
| 673 | Ambrosia trifida | PPOX_B32_20 | gDNA Contig | 3326 | 3525 |
| 674 | Ambrosia trifida | PPOX_B32_21 | gDNA Contig | 3501 | 3700 |
| 675 | Ambrosia trifida | PPOX_B32_21 | gDNA Contig | 3501 | 3700 |
| 676 | Ambrosia trifida | PPOX_B32_22 | gDNA Contig | 3676 | 3875 |
| 677 | Ambrosia trifida | PPOX_B32_22 | gDNA Contig | 3676 | 3875 |
| 678 | Ambrosia trifida | PPOX_B32_23 | gDNA Contig | 3851 | 4050 |
| 679 | Ambrosia trifida | PPOX_B32_23 | gDNA Contig | 3851 | 4050 |
| 680 | Ambrosia trifida | PPOX_B32_24 | gDNA Contig | 4026 | 4225 |
| 681 | Ambrosia trifida | PPOX_B32_24 | gDNA Contig | 4026 | 4225 |
| 682 | Ambrosia trifida | PPOX_B32_25 | gDNA Contig | 4201 | 4400 |
| 683 | Ambrosia trifida | PPOX_B32_25 | gDNA Contig | 4201 | 4400 |
| 684 | Ambrosia trifida | PPOX_B32_26 | gDNA Contig | 4376 | 4575 |
| 685 | Ambrosia trifida | PPOX_B32_26 | gDNA Contig | 4376 | 4575 |
| 686 | Ambrosia trifida | PPOX_B32_27 | gDNA Contig | 4551 | 4750 |
| 687 | Ambrosia trifida | PPOX_B32_27 | gDNA Contig | 4551 | 4750 |
| 688 | Ambrosia trifida | PPOX_B30_1 | cDNA Contig | 1 | 200 |
| 689 | Ambrosia trifida | PPOX_B30_1 | cDNA Contig | 1 | 200 |
| 690 | Ambrosia trifida | PPOX_B30_2 | cDNA Contig | 176 | 375 |
| 691 | Ambrosia trifida | PPOX_B30_2 | cDNA Contig | 176 | 375 |
| 692 | Ambrosia trifida | PPOX_B30_3 | cDNA Contig | 351 | 550 |
| 693 | Ambrosia trifida | PPOX_B30_3 | cDNA Contig | 351 | 550 |
| 694 | Ambrosia trifida | PPOX_B30_4 | cDNA Contig | 526 | 725 |
| 695 | Ambrosia trifida | PPOX_B30_4 | cDNA Contig | 526 | 725 |
| 696 | Ambrosia trifida | PPOX_B30_5 | cDNA Contig | 701 | 900 |
| 697 | Ambrosia trifida | PPOX_B30_5 | cDNA Contig | 701 | 900 |
| 698 | Ambrosia trifida | PPOX_B29_1 | cDNA Contig | 1 | 200 |
| 699 | Ambrosia trifida | PPOX_B29_1 | cDNA Contig | 1 | 200 |
| 700 | Ambrosia trifida | PPOX_B29_2 | cDNA Contig | 176 | 375 |
| 701 | Ambrosia trifida | PPOX_B29_2 | cDNA Contig | 176 | 375 |

TABLE 2-continued

| SEQ ID NO | Species | Name | Reference | Type | Start | End |
|---|---|---|---|---|---|
| 702 | Ambrosia trifida | PPOX_B29_3 | cDNA Contig | 351 | 550 |
| 703 | Ambrosia trifida | PPOX_B29_3 | cDNA Contig | 351 | 550 |
| 704 | Ambrosia trifida | PPOX_B29_4 | cDNA Contig | 526 | 725 |
| 705 | Ambrosia trifida | PPOX_B29_4 | cDNA Contig | 526 | 725 |
| 706 | Ambrosia trifida | PPOX_B29_5 | cDNA Contig | 701 | 900 |
| 707 | Ambrosia trifida | PPOX_B29_5 | cDNA Contig | 701 | 900 |
| 708 | Ambrosia trifida | PPOX_B29_6 | cDNA Contig | 876 | 1075 |
| 709 | Ambrosia trifida | PPOX_B29_6 | cDNA Contig | 876 | 1075 |
| 710 | Ambrosia trifida | PPOX_B29_7 | cDNA Contig | 1051 | 1250 |
| 711 | Ambrosia trifida | PPOX_B29_7 | cDNA Contig | 1051 | 1250 |
| 712 | Ambrosia trifida | PPOX_B29_8 | cDNA Contig | 1226 | 1425 |
| 713 | Ambrosia trifida | PPOX_B29_8 | cDNA Contig | 1226 | 1425 |
| 714 | Ambrosia trifida | PPOX_B29_9 | cDNA Contig | 1401 | 1600 |
| 715 | Ambrosia trifida | PPOX_B29_9 | cDNA Contig | 1401 | 1600 |
| 716 | Ambrosia trifida | PPOX_B29_10 | cDNA Contig | 1576 | 1775 |
| 717 | Ambrosia trifida | PPOX_B29_10 | cDNA Contig | 1576 | 1775 |
| 718 | Ambrosia trifida | PPOX_B33_1 | gDNA Contig | 1 | 200 |
| 719 | Ambrosia trifida | PPOX_B33_1 | gDNA Contig | 1 | 200 |
| 720 | Ambrosia trifida | PPOX_B33_2 | gDNA Contig | 176 | 375 |
| 721 | Ambrosia trifida | PPOX_B33_2 | gDNA Contig | 176 | 375 |
| 722 | Ambrosia trifida | PPOX_B33_3 | gDNA Contig | 351 | 550 |
| 723 | Ambrosia trifida | PPOX_B33_3 | gDNA Contig | 351 | 550 |
| 724 | Ambrosia trifida | PPOX_B33_4 | gDNA Contig | 526 | 725 |
| 725 | Ambrosia trifida | PPOX_B33_4 | gDNA Contig | 526 | 725 |
| 726 | Ambrosia trifida | PPOX_B31_1 | cDNA Contig | 1 | 200 |
| 727 | Ambrosia trifida | PPOX_B31_1 | cDNA Contig | 1 | 200 |
| 728 | Ambrosia trifida | PPOX_B31_2 | cDNA Contig | 176 | 375 |
| 729 | Ambrosia trifida | PPOX_B31_2 | cDNA Contig | 176 | 375 |
| 730 | Ambrosia trifida | PPOX_B31_3 | cDNA Contig | 351 | 550 |
| 731 | Ambrosia trifida | PPOX_B31_3 | cDNA Contig | 351 | 550 |
| 732 | Ambrosia trifida | PPOX_B31_4 | cDNA Contig | 526 | 725 |
| 733 | Ambrosia trifida | PPOX_B31_4 | cDNA Contig | 526 | 725 |
| 734 | Chenopodium album | PPOX_B35_1 | cDNA Contig | 1 | 200 |
| 735 | Chenopodium album | PPOX_B35_1 | cDNA Contig | 1 | 200 |
| 736 | Chenopodium album | PPOX_B35_2 | cDNA Contig | 176 | 375 |
| 737 | Chenopodium album | PPOX_B35_2 | cDNA Contig | 176 | 375 |
| 738 | Chenopodium album | PPOX_B35_3 | cDNA Contig | 351 | 550 |
| 739 | Chenopodium album | PPOX_B35_3 | cDNA Contig | 351 | 550 |
| 740 | Chenopodium album | PPOX_B35_4 | cDNA Contig | 526 | 725 |
| 741 | Chenopodium album | PPOX_B35_4 | cDNA Contig | 526 | 725 |
| 742 | Chenopodium album | PPOX_B35_5 | cDNA Contig | 701 | 900 |
| 743 | Chenopodium album | PPOX_B35_5 | cDNA Contig | 701 | 900 |
| 744 | Chenopodium album | PPOX_B35_6 | cDNA Contig | 876 | 1075 |
| 745 | Chenopodium album | PPOX_B35_6 | cDNA Contig | 876 | 1075 |
| 746 | Chenopodium album | PPOX_B35_7 | cDNA Contig | 1051 | 1250 |
| 747 | Chenopodium album | PPOX_B35_7 | cDNA Contig | 1051 | 1250 |
| 748 | Chenopodium album | PPOX_B35_8 | cDNA Contig | 1226 | 1425 |
| 749 | Chenopodium album | PPOX_B35_8 | cDNA Contig | 1226 | 1425 |
| 750 | Chenopodium album | PPOX_B35_9 | cDNA Contig | 1401 | 1600 |
| 751 | Chenopodium album | PPOX_B35_9 | cDNA Contig | 1401 | 1600 |
| 752 | Commelina diffusa | PPOX_B50_1 | gDNA Contig | 1 | 200 |
| 753 | Commelina diffusa | PPOX_B50_1 | gDNA Contig | 1 | 200 |
| 754 | Commelina diffusa | PPOX_B50_2 | gDNA Contig | 176 | 375 |
| 755 | Commelina diffusa | PPOX_B50_2 | gDNA Contig | 176 | 375 |
| 756 | Commelina diffusa | PPOX_B50_3 | gDNA Contig | 351 | 550 |
| 757 | Commelina diffusa | PPOX_B50_3 | gDNA Contig | 351 | 550 |
| 758 | Commelina diffusa | PPOX_B50_4 | gDNA Contig | 526 | 725 |
| 759 | Commelina diffusa | PPOX_B50_4 | gDNA Contig | 526 | 725 |
| 760 | Commelina diffusa | PPOX_B50_5 | gDNA Contig | 701 | 900 |
| 761 | Commelina diffusa | PPOX_B50_5 | gDNA Contig | 701 | 900 |
| 762 | Commelina diffusa | PPOX_B50_6 | gDNA Contig | 876 | 1075 |
| 763 | Commelina diffusa | PPOX_B50_6 | gDNA Contig | 876 | 1075 |
| 764 | Commelina diffusa | PPOX_B50_7 | gDNA Contig | 1051 | 1250 |
| 765 | Commelina diffusa | PPOX_B50_7 | gDNA Contig | 1051 | 1250 |
| 766 | Commelina diffusa | PPOX_B50_8 | gDNA Contig | 1226 | 1425 |
| 767 | Commelina diffusa | PPOX_B50_8 | gDNA Contig | 1226 | 1425 |
| 768 | Commelina diffusa | PPOX_B50_9 | gDNA Contig | 1401 | 1600 |
| 769 | Commelina diffusa | PPOX_B50_9 | gDNA Contig | 1401 | 1600 |
| 770 | Commelina diffusa | PPOX_B50_10 | gDNA Contig | 1576 | 1775 |
| 771 | Commelina diffusa | PPOX_B50_10 | gDNA Contig | 1576 | 1775 |
| 772 | Commelina diffusa | PPOX_B50_11 | gDNA Contig | 1751 | 1950 |
| 773 | Commelina diffusa | PPOX_B50_11 | gDNA Contig | 1751 | 1950 |
| 774 | Commelina diffusa | PPOX_B50_12 | gDNA Contig | 1926 | 2125 |
| 775 | Commelina diffusa | PPOX_B50_12 | gDNA Contig | 1926 | 2125 |
| 776 | Commelina diffusa | PPOX_B50_13 | gDNA Contig | 2101 | 2300 |
| 777 | Commelina diffusa | PPOX_B50_13 | gDNA Contig | 2101 | 2300 |
| 778 | Commelina diffusa | PPOX_B50_14 | gDNA Contig | 2276 | 2475 |

TABLE 2-continued

| SEQ ID NO | Species | Name | Reference | Type | Start | End |
|---|---|---|---|---|---|
| 779 | Commelina diffusa | PPOX_B50_14 | gDNA Contig | 2276 | 2475 |
| 780 | Commelina diffusa | PPOX_B50_15 | gDNA Contig | 2451 | 2650 |
| 781 | Commelina diffusa | PPOX_B50_15 | gDNA Contig | 2451 | 2650 |
| 782 | Commelina diffusa | PPOX_B50_16 | gDNA Contig | 2626 | 2825 |
| 783 | Commelina diffusa | PPOX_B50_16 | gDNA Contig | 2626 | 2825 |
| 784 | Commelina diffusa | PPOX_B50_17 | gDNA Contig | 2801 | 3000 |
| 785 | Commelina diffusa | PPOX_B50_17 | gDNA Contig | 2801 | 3000 |
| 786 | Commelina diffusa | PPOX_B51_1 | gDNA Contig | 1 | 200 |
| 787 | Commelina diffusa | PPOX_B51_1 | gDNA Contig | 1 | 200 |
| 788 | Commelina diffusa | PPOX_B51_2 | gDNA Contig | 176 | 375 |
| 789 | Commelina diffusa | PPOX_B51_2 | gDNA Contig | 176 | 375 |
| 790 | Commelina diffusa | PPOX_B51_3 | gDNA Contig | 351 | 550 |
| 791 | Commelina diffusa | PPOX_B51_3 | gDNA Contig | 351 | 550 |
| 792 | Commelina diffusa | PPOX_B51_4 | gDNA Contig | 526 | 725 |
| 793 | Commelina diffusa | PPOX_B51_4 | gDNA Contig | 526 | 725 |
| 794 | Commelina diffusa | PPOX_B51_5 | gDNA Contig | 701 | 900 |
| 795 | Commelina diffusa | PPOX_B51_5 | gDNA Contig | 701 | 900 |
| 796 | Commelina diffusa | PPOX_B51_6 | gDNA Contig | 876 | 1075 |
| 797 | Commelina diffusa | PPOX_B51_6 | gDNA Contig | 876 | 1075 |
| 798 | Commelina diffusa | PPOX_B51_7 | gDNA Contig | 1051 | 1250 |
| 799 | Commelina diffusa | PPOX_B51_7 | gDNA Contig | 1051 | 1250 |
| 800 | Commelina diffusa | PPOX_B51_8 | gDNA Contig | 1226 | 1425 |
| 801 | Commelina diffusa | PPOX_B51_8 | gDNA Contig | 1226 | 1425 |
| 802 | Commelina diffusa | PPOX_B49_1 | cDNA Contig | 1 | 200 |
| 803 | Commelina diffusa | PPOX_B49_1 | cDNA Contig | 1 | 200 |
| 804 | Commelina diffusa | PPOX_B49_2 | cDNA Contig | 176 | 375 |
| 805 | Commelina diffusa | PPOX_B49_2 | cDNA Contig | 176 | 375 |
| 806 | Commelina diffusa | PPOX_B52_1 | gDNA Contig | 1 | 200 |
| 807 | Commelina diffusa | PPOX_B52_1 | gDNA Contig | 1 | 200 |
| 808 | Commelina diffusa | PPOX_B52_2 | gDNA Contig | 176 | 375 |
| 809 | Commelina diffusa | PPOX_B52_2 | gDNA Contig | 176 | 375 |
| 810 | Commelina diffusa | PPOX_B52_3 | gDNA Contig | 351 | 550 |
| 811 | Commelina diffusa | PPOX_B52_3 | gDNA Contig | 351 | 550 |
| 812 | Conyza canadensis | PPOX_B38_1 | gDNA Contig | 1 | 200 |
| 813 | Conyza canadensis | PPOX_B38_1 | gDNA Contig | 1 | 200 |
| 814 | Conyza canadensis | PPOX_B38_2 | gDNA Contig | 176 | 375 |
| 815 | Conyza canadensis | PPOX_B38_2 | gDNA Contig | 176 | 375 |
| 816 | Conyza canadensis | PPOX_B38_3 | gDNA Contig | 351 | 550 |
| 817 | Conyza canadensis | PPOX_B38_3 | gDNA Contig | 351 | 550 |
| 818 | Conyza canadensis | PPOX_B38_4 | gDNA Contig | 526 | 725 |
| 819 | Conyza canadensis | PPOX_B38_4 | gDNA Contig | 526 | 725 |
| 820 | Conyza canadensis | PPOX_B38_5 | gDNA Contig | 701 | 900 |
| 821 | Conyza canadensis | PPOX_B38_5 | gDNA Contig | 701 | 900 |
| 822 | Conyza canadensis | PPOX_B38_6 | gDNA Contig | 876 | 1075 |
| 823 | Conyza canadensis | PPOX_B38_6 | gDNA Contig | 876 | 1075 |
| 824 | Conyza canadensis | PPOX_B38_7 | gDNA Contig | 1051 | 1250 |
| 825 | Conyza canadensis | PPOX_B38_7 | gDNA Contig | 1051 | 1250 |
| 826 | Conyza canadensis | PPOX_B38_8 | gDNA Contig | 1226 | 1425 |
| 827 | Conyza canadensis | PPOX_B38_8 | gDNA Contig | 1226 | 1425 |
| 828 | Conyza canadensis | PPOX_B38_9 | gDNA Contig | 1401 | 1600 |
| 829 | Conyza canadensis | PPOX_B38_9 | gDNA Contig | 1401 | 1600 |
| 830 | Conyza canadensis | PPOX_B38_10 | gDNA Contig | 1576 | 1775 |
| 831 | Conyza canadensis | PPOX_B38_10 | gDNA Contig | 1576 | 1775 |
| 832 | Conyza canadensis | PPOX_B38_11 | gDNA Contig | 1751 | 1950 |
| 833 | Conyza canadensis | PPOX_B38_11 | gDNA Contig | 1751 | 1950 |
| 834 | Conyza canadensis | PPOX_B38_12 | gDNA Contig | 1926 | 2125 |
| 835 | Conyza canadensis | PPOX_B38_12 | gDNA Contig | 1926 | 2125 |
| 836 | Conyza canadensis | PPOX_B38_13 | gDNA Contig | 2101 | 2300 |
| 837 | Conyza canadensis | PPOX_B38_13 | gDNA Contig | 2101 | 2300 |
| 838 | Conyza canadensis | PPOX_B38_14 | gDNA Contig | 2276 | 2475 |
| 839 | Conyza canadensis | PPOX_B38_14 | gDNA Contig | 2276 | 2475 |
| 840 | Conyza canadensis | PPOX_B38_15 | gDNA Contig | 2451 | 2650 |
| 841 | Conyza canadensis | PPOX_B38_15 | gDNA Contig | 2451 | 2650 |
| 842 | Conyza canadensis | PPOX_B38_16 | gDNA Contig | 2626 | 2825 |
| 843 | Conyza canadensis | PPOX_B38_16 | gDNA Contig | 2626 | 2825 |
| 844 | Conyza canadensis | PPOX_B38_17 | gDNA Contig | 2801 | 3000 |
| 845 | Conyza canadensis | PPOX_B38_17 | gDNA Contig | 2801 | 3000 |
| 846 | Conyza canadensis | PPOX_B38_18 | gDNA Contig | 2976 | 3175 |
| 847 | Conyza canadensis | PPOX_B38_18 | gDNA Contig | 2976 | 3175 |
| 848 | Conyza canadensis | PPOX_B38_19 | gDNA Contig | 3151 | 3350 |
| 849 | Conyza canadensis | PPOX_B38_19 | gDNA Contig | 3151 | 3350 |
| 850 | Conyza canadensis | PPOX_B38_20 | gDNA Contig | 3326 | 3525 |
| 851 | Conyza canadensis | PPOX_B38_20 | gDNA Contig | 3326 | 3525 |
| 852 | Conyza canadensis | PPOX_B38_21 | gDNA Contig | 3501 | 3700 |
| 853 | Conyza canadensis | PPOX_B38_21 | gDNA Contig | 3501 | 3700 |
| 854 | Conyza canadensis | PPOX_B38_22 | gDNA Contig | 3676 | 3875 |
| 855 | Conyza canadensis | PPOX_B38_22 | gDNA Contig | 3676 | 3875 |

TABLE 2-continued

| SEQ ID NO | Species | Name / Reference | Type | Start | End |
|---|---|---|---|---|---|
| 856 | Conyza canadensis | PPOX_B38_23 | gDNA Contig | 3851 | 4050 |
| 857 | Conyza canadensis | PPOX_B38_23 | gDNA Contig | 3851 | 4050 |
| 858 | Conyza canadensis | PPOX_B38_24 | gDNA Contig | 4026 | 4225 |
| 859 | Conyza canadensis | PPOX_B38_24 | gDNA Contig | 4026 | 4225 |
| 860 | Conyza canadensis | PPOX_B38_25 | gDNA Contig | 4201 | 4400 |
| 861 | Conyza canadensis | PPOX_B38_25 | gDNA Contig | 4201 | 4400 |
| 862 | Conyza canadensis | PPOX_B38_26 | gDNA Contig | 4376 | 4575 |
| 863 | Conyza canadensis | PPOX_B38_26 | gDNA Contig | 4376 | 4575 |
| 864 | Conyza canadensis | PPOX_B38_27 | gDNA Contig | 4551 | 4750 |
| 865 | Conyza canadensis | PPOX_B38_27 | gDNA Contig | 4551 | 4750 |
| 866 | Conyza canadensis | PPOX_B38_28 | gDNA Contig | 4726 | 4925 |
| 867 | Conyza canadensis | PPOX_B38_28 | gDNA Contig | 4726 | 4925 |
| 868 | Conyza canadensis | PPOX_B38_29 | gDNA Contig | 4901 | 5100 |
| 869 | Conyza canadensis | PPOX_B38_29 | gDNA Contig | 4901 | 5100 |
| 870 | Conyza canadensis | PPOX_B38_30 | gDNA Contig | 5076 | 5275 |
| 871 | Conyza canadensis | PPOX_B38_30 | gDNA Contig | 5076 | 5275 |
| 872 | Conyza canadensis | PPOX_B38_31 | gDNA Contig | 5251 | 5450 |
| 873 | Conyza canadensis | PPOX_B38_31 | gDNA Contig | 5251 | 5450 |
| 874 | Conyza canadensis | PPOX_B38_32 | gDNA Contig | 5426 | 5625 |
| 875 | Conyza canadensis | PPOX_B38_32 | gDNA Contig | 5426 | 5625 |
| 876 | Conyza canadensis | PPOX_B38_33 | gDNA Contig | 5601 | 5800 |
| 877 | Conyza canadensis | PPOX_B38_33 | gDNA Contig | 5601 | 5800 |
| 878 | Conyza canadensis | PPOX_B38_34 | gDNA Contig | 5776 | 5975 |
| 879 | Conyza canadensis | PPOX_B38_34 | gDNA Contig | 5776 | 5975 |
| 880 | Conyza canadensis | PPOX_B38_35 | gDNA Contig | 5951 | 6150 |
| 881 | Conyza canadensis | PPOX_B38_35 | gDNA Contig | 5951 | 6150 |
| 882 | Conyza canadensis | PPOX_B38_36 | gDNA Contig | 6126 | 6325 |
| 883 | Conyza canadensis | PPOX_B38_36 | gDNA Contig | 6126 | 6325 |
| 884 | Conyza canadensis | PPOX_B38_37 | gDNA Contig | 6301 | 6500 |
| 885 | Conyza canadensis | PPOX_B38_37 | gDNA Contig | 6301 | 6500 |
| 886 | Conyza canadensis | PPOX_B38_38 | gDNA Contig | 6476 | 6675 |
| 887 | Conyza canadensis | PPOX_B38_38 | gDNA Contig | 6476 | 6675 |
| 888 | Conyza canadensis | PPOX_B38_39 | gDNA Contig | 6651 | 6850 |
| 889 | Conyza canadensis | PPOX_B38_39 | gDNA Contig | 6651 | 6850 |
| 890 | Conyza canadensis | PPOX_B38_40 | gDNA Contig | 6826 | 7025 |
| 891 | Conyza canadensis | PPOX_B38_40 | gDNA Contig | 6826 | 7025 |
| 892 | Conyza canadensis | PPOX_B38_41 | gDNA Contig | 7001 | 7200 |
| 893 | Conyza canadensis | PPOX_B38_41 | gDNA Contig | 7001 | 7200 |
| 894 | Conyza canadensis | PPOX_B38_42 | gDNA Contig | 7176 | 7375 |
| 895 | Conyza canadensis | PPOX_B38_42 | gDNA Contig | 7176 | 7375 |
| 896 | Conyza canadensis | PPOX_B38_43 | gDNA Contig | 7351 | 7550 |
| 897 | Conyza canadensis | PPOX_B38_43 | gDNA Contig | 7351 | 7550 |
| 898 | Conyza canadensis | PPOX_B38_44 | gDNA Contig | 7526 | 7725 |
| 899 | Conyza canadensis | PPOX_B38_44 | gDNA Contig | 7526 | 7725 |
| 900 | Conyza canadensis | PPOX_B38_45 | gDNA Contig | 7701 | 7900 |
| 901 | Conyza canadensis | PPOX_B38_45 | gDNA Contig | 7701 | 7900 |
| 902 | Conyza canadensis | PPOX_B38_46 | gDNA Contig | 7876 | 8075 |
| 903 | Conyza canadensis | PPOX_B38_46 | gDNA Contig | 7876 | 8075 |
| 904 | Conyza canadensis | PPOX_B38_47 | gDNA Contig | 8051 | 8250 |
| 905 | Conyza canadensis | PPOX_B38_47 | gDNA Contig | 8051 | 8250 |
| 906 | Conyza canadensis | PPOX_B38_48 | gDNA Contig | 8226 | 8425 |
| 907 | Conyza canadensis | PPOX_B38_48 | gDNA Contig | 8226 | 8425 |
| 908 | Conyza canadensis | PPOX_B38_49 | gDNA Contig | 8401 | 8600 |
| 909 | Conyza canadensis | PPOX_B38_49 | gDNA Contig | 8401 | 8600 |
| 910 | Conyza canadensis | PPOX_B38_50 | gDNA Contig | 8576 | 8775 |
| 911 | Conyza canadensis | PPOX_B38_50 | gDNA Contig | 8576 | 8775 |
| 912 | Conyza canadensis | PPOX_B38_51 | gDNA Contig | 8751 | 8950 |
| 913 | Conyza canadensis | PPOX_B38_51 | gDNA Contig | 8751 | 8950 |
| 914 | Conyza canadensis | PPOX_B38_52 | gDNA Contig | 8926 | 9125 |
| 915 | Conyza canadensis | PPOX_B38_52 | gDNA Contig | 8926 | 9125 |
| 916 | Conyza canadensis | PPOX_B38_53 | gDNA Contig | 9101 | 9300 |
| 917 | Conyza canadensis | PPOX_B38_53 | gDNA Contig | 9101 | 9300 |
| 918 | Conyza canadensis | PPOX_B38_54 | gDNA Contig | 9276 | 9475 |
| 919 | Conyza canadensis | PPOX_B38_54 | gDNA Contig | 9276 | 9475 |
| 920 | Conyza canadensis | PPOX_B38_55 | gDNA Contig | 9451 | 9650 |
| 921 | Conyza canadensis | PPOX_B38_55 | gDNA Contig | 9451 | 9650 |
| 922 | Conyza canadensis | PPOX_B38_56 | gDNA Contig | 9626 | 9825 |
| 923 | Conyza canadensis | PPOX_B38_56 | gDNA Contig | 9626 | 9825 |
| 924 | Conyza canadensis | PPOX_B38_57 | gDNA Contig | 9801 | 10000 |
| 925 | Conyza canadensis | PPOX_B38_57 | gDNA Contig | 9801 | 10000 |
| 926 | Conyza canadensis | PPOX_B38_58 | gDNA Contig | 9976 | 10175 |
| 927 | Conyza canadensis | PPOX_B38_58 | gDNA Contig | 9976 | 10175 |
| 928 | Conyza canadensis | PPOX_B38_59 | gDNA Contig | 10151 | 10350 |
| 929 | Conyza canadensis | PPOX_B38_59 | gDNA Contig | 10151 | 10350 |
| 930 | Conyza canadensis | PPOX_B38_60 | gDNA Contig | 10326 | 10525 |
| 931 | Conyza canadensis | PPOX_B38_60 | gDNA Contig | 10326 | 10525 |
| 932 | Conyza canadensis | PPOX_B39_1 | gDNA Contig | 1 | 200 |

TABLE 2-continued

| SEQ ID NO | Species | Name / Reference | Type | Start | End |
|---|---|---|---|---|---|
| 933 | Conyza canadensis | PPOX_B39_1 | gDNA Contig | 1 | 200 |
| 934 | Conyza canadensis | PPOX_B39_2 | gDNA Contig | 176 | 375 |
| 935 | Conyza canadensis | PPOX_B39_2 | gDNA Contig | 176 | 375 |
| 936 | Conyza canadensis | PPOX_B39_3 | gDNA Contig | 351 | 550 |
| 937 | Conyza canadensis | PPOX_B39_3 | gDNA Contig | 351 | 550 |
| 938 | Conyza canadensis | PPOX_B39_4 | gDNA Contig | 526 | 725 |
| 939 | Conyza canadensis | PPOX_B39_4 | gDNA Contig | 526 | 725 |
| 940 | Conyza canadensis | PPOX_B39_5 | gDNA Contig | 701 | 900 |
| 941 | Conyza canadensis | PPOX_B39_5 | gDNA Contig | 701 | 900 |
| 942 | Conyza canadensis | PPOX_B39_6 | gDNA Contig | 876 | 1075 |
| 943 | Conyza canadensis | PPOX_B39_6 | gDNA Contig | 876 | 1075 |
| 944 | Conyza canadensis | PPOX_B39_7 | gDNA Contig | 1051 | 1250 |
| 945 | Conyza canadensis | PPOX_B39_7 | gDNA Contig | 1051 | 1250 |
| 946 | Conyza canadensis | PPOX_B39_8 | gDNA Contig | 1226 | 1425 |
| 947 | Conyza canadensis | PPOX_B39_8 | gDNA Contig | 1226 | 1425 |
| 948 | Conyza canadensis | PPOX_B39_9 | gDNA Contig | 1401 | 1600 |
| 949 | Conyza canadensis | PPOX_B39_9 | gDNA Contig | 1401 | 1600 |
| 950 | Conyza canadensis | PPOX_B39_10 | gDNA Contig | 1576 | 1775 |
| 951 | Conyza canadensis | PPOX_B39_10 | gDNA Contig | 1576 | 1775 |
| 952 | Conyza canadensis | PPOX_B39_11 | gDNA Contig | 1751 | 1950 |
| 953 | Conyza canadensis | PPOX_B39_11 | gDNA Contig | 1751 | 1950 |
| 954 | Conyza canadensis | PPOX_B39_12 | gDNA Contig | 1926 | 2125 |
| 955 | Conyza canadensis | PPOX_B39_12 | gDNA Contig | 1926 | 2125 |
| 956 | Conyza canadensis | PPOX_B39_13 | gDNA Contig | 2101 | 2300 |
| 957 | Conyza canadensis | PPOX_B39_13 | gDNA Contig | 2101 | 2300 |
| 958 | Conyza canadensis | PPOX_B39_14 | gDNA Contig | 2276 | 2475 |
| 959 | Conyza canadensis | PPOX_B39_14 | gDNA Contig | 2276 | 2475 |
| 960 | Conyza canadensis | PPOX_B39_15 | gDNA Contig | 2451 | 2650 |
| 961 | Conyza canadensis | PPOX_B39_15 | gDNA Contig | 2451 | 2650 |
| 962 | Conyza canadensis | PPOX_B39_16 | gDNA Contig | 2626 | 2825 |
| 963 | Conyza canadensis | PPOX_B39_16 | gDNA Contig | 2626 | 2825 |
| 964 | Conyza canadensis | PPOX_B39_17 | gDNA Contig | 2801 | 3000 |
| 965 | Conyza canadensis | PPOX_B39_17 | gDNA Contig | 2801 | 3000 |
| 966 | Conyza canadensis | PPOX_B39_18 | gDNA Contig | 2976 | 3175 |
| 967 | Conyza canadensis | PPOX_B39_18 | gDNA Contig | 2976 | 3175 |
| 968 | Conyza canadensis | PPOX_B39_19 | gDNA Contig | 3151 | 3350 |
| 969 | Conyza canadensis | PPOX_B39_19 | gDNA Contig | 3151 | 3350 |
| 970 | Conyza canadensis | PPOX_B39_20 | gDNA Contig | 3326 | 3525 |
| 971 | Conyza canadensis | PPOX_B39_20 | gDNA Contig | 3326 | 3525 |
| 972 | Conyza canadensis | PPOX_B39_21 | gDNA Contig | 3501 | 3700 |
| 973 | Conyza canadensis | PPOX_B39_21 | gDNA Contig | 3501 | 3700 |
| 974 | Conyza canadensis | PPOX_B39_22 | gDNA Contig | 3676 | 3875 |
| 975 | Conyza canadensis | PPOX_B39_22 | gDNA Contig | 3676 | 3875 |
| 976 | Conyza canadensis | PPOX_B39_23 | gDNA Contig | 3851 | 4050 |
| 977 | Conyza canadensis | PPOX_B39_23 | gDNA Contig | 3851 | 4050 |
| 978 | Conyza canadensis | PPOX_B39_24 | gDNA Contig | 4026 | 4225 |
| 979 | Conyza canadensis | PPOX_B39_24 | gDNA Contig | 4026 | 4225 |
| 980 | Conyza canadensis | PPOX_B39_25 | gDNA Contig | 4201 | 4400 |
| 981 | Conyza canadensis | PPOX_B39_25 | gDNA Contig | 4201 | 4400 |
| 982 | Conyza canadensis | PPOX_B39_26 | gDNA Contig | 4376 | 4575 |
| 983 | Conyza canadensis | PPOX_B39_26 | gDNA Contig | 4376 | 4575 |
| 984 | Conyza canadensis | PPOX_B39_27 | gDNA Contig | 4551 | 4750 |
| 985 | Conyza canadensis | PPOX_B39_27 | gDNA Contig | 4551 | 4750 |
| 986 | Conyza canadensis | PPOX_B39_28 | gDNA Contig | 4726 | 4925 |
| 987 | Conyza canadensis | PPOX_B39_28 | gDNA Contig | 4726 | 4925 |
| 988 | Conyza canadensis | PPOX_B39_29 | gDNA Contig | 4901 | 5100 |
| 989 | Conyza canadensis | PPOX_B39_29 | gDNA Contig | 4901 | 5100 |
| 990 | Conyza canadensis | PPOX_B39_30 | gDNA Contig | 5076 | 5275 |
| 991 | Conyza canadensis | PPOX_B39_30 | gDNA Contig | 5076 | 5275 |
| 992 | Conyza canadensis | PPOX_B39_31 | gDNA Contig | 5251 | 5450 |
| 993 | Conyza canadensis | PPOX_B39_31 | gDNA Contig | 5251 | 5450 |
| 994 | Conyza canadensis | PPOX_B39_32 | gDNA Contig | 5426 | 5625 |
| 995 | Conyza canadensis | PPOX_B39_32 | gDNA Contig | 5426 | 5625 |
| 996 | Conyza canadensis | PPOX_B39_33 | gDNA Contig | 5601 | 5800 |
| 997 | Conyza canadensis | PPOX_B39_33 | gDNA Contig | 5601 | 5800 |
| 998 | Conyza canadensis | PPOX_B39_34 | gDNA Contig | 5776 | 5975 |
| 999 | Conyza canadensis | PPOX_B39_34 | gDNA Contig | 5776 | 5975 |
| 1000 | Conyza canadensis | PPOX_B39_35 | gDNA Contig | 5951 | 6150 |
| 1001 | Conyza canadensis | PPOX_B39_35 | gDNA Contig | 5951 | 6150 |
| 1002 | Conyza canadensis | PPOX_B39_36 | gDNA Contig | 6126 | 6325 |
| 1003 | Conyza canadensis | PPOX_B39_36 | gDNA Contig | 6126 | 6325 |
| 1004 | Conyza canadensis | PPOX_B39_37 | gDNA Contig | 6301 | 6500 |
| 1005 | Conyza canadensis | PPOX_B39_37 | gDNA Contig | 6301 | 6500 |
| 1006 | Conyza canadensis | PPOX_B39_38 | gDNA Contig | 6476 | 6675 |
| 1007 | Conyza canadensis | PPOX_B39_38 | gDNA Contig | 6476 | 6675 |
| 1008 | Conyza canadensis | PPOX_B39_39 | gDNA Contig | 6651 | 6850 |
| 1009 | Conyza canadensis | PPOX_B39_39 | gDNA Contig | 6651 | 6850 |

TABLE 2-continued

| SEQ ID NO | Species | Name \| Reference | Type | Start | End |
|---|---|---|---|---|---|
| 1010 | Conyza canadensis | PPOX_B39_40 | gDNA Contig | 6826 | 7025 |
| 1011 | Conyza canadensis | PPOX_B39_40 | gDNA Contig | 6826 | 7025 |
| 1012 | Conyza canadensis | PPOX_B39_41 | gDNA Contig | 7001 | 7200 |
| 1013 | Conyza canadensis | PPOX_B39_41 | gDNA Contig | 7001 | 7200 |
| 1014 | Conyza canadensis | PPOX_B39_42 | gDNA Contig | 7176 | 7375 |
| 1015 | Conyza canadensis | PPOX_B39_42 | gDNA Contig | 7176 | 7375 |
| 1016 | Conyza canadensis | PPOX_B39_43 | gDNA Contig | 7351 | 7550 |
| 1017 | Conyza canadensis | PPOX_B39_43 | gDNA Contig | 7351 | 7550 |
| 1018 | Conyza canadensis | PPOX_B39_44 | gDNA Contig | 7526 | 7725 |
| 1019 | Conyza canadensis | PPOX_B39_44 | gDNA Contig | 7526 | 7725 |
| 1020 | Conyza canadensis | PPOX_B39_45 | gDNA Contig | 7701 | 7900 |
| 1021 | Conyza canadensis | PPOX_B39_45 | gDNA Contig | 7701 | 7900 |
| 1022 | Conyza canadensis | PPOX_B39_46 | gDNA Contig | 7876 | 8075 |
| 1023 | Conyza canadensis | PPOX_B39_46 | gDNA Contig | 7876 | 8075 |
| 1024 | Conyza canadensis | PPOX_B39_47 | gDNA Contig | 8051 | 8250 |
| 1025 | Conyza canadensis | PPOX_B39_47 | gDNA Contig | 8051 | 8250 |
| 1026 | Conyza canadensis | PPOX_B39_48 | gDNA Contig | 8226 | 8425 |
| 1027 | Conyza canadensis | PPOX_B39_48 | gDNA Contig | 8226 | 8425 |
| 1028 | Conyza canadensis | PPOX_B39_49 | gDNA Contig | 8401 | 8600 |
| 1029 | Conyza canadensis | PPOX_B39_49 | gDNA Contig | 8401 | 8600 |
| 1030 | Conyza canadensis | PPOX_B39_50 | gDNA Contig | 8576 | 8775 |
| 1031 | Conyza canadensis | PPOX_B39_50 | gDNA Contig | 8576 | 8775 |
| 1032 | Conyza canadensis | PPOX_B39_51 | gDNA Contig | 8751 | 8950 |
| 1033 | Conyza canadensis | PPOX_B39_51 | gDNA Contig | 8751 | 8950 |
| 1034 | Conyza canadensis | PPOX_B39_52 | gDNA Contig | 8926 | 9125 |
| 1035 | Conyza canadensis | PPOX_B39_52 | gDNA Contig | 8926 | 9125 |
| 1036 | Conyza canadensis | PPOX_B39_53 | gDNA Contig | 9101 | 9300 |
| 1037 | Conyza canadensis | PPOX_B39_53 | gDNA Contig | 9101 | 9300 |
| 1038 | Conyza canadensis | PPOX_B39_54 | gDNA Contig | 9276 | 9475 |
| 1039 | Conyza canadensis | PPOX_B39_54 | gDNA Contig | 9276 | 9475 |
| 1040 | Conyza canadensis | PPOX_B39_55 | gDNA Contig | 9451 | 9650 |
| 1041 | Conyza canadensis | PPOX_B39_55 | gDNA Contig | 9451 | 9650 |
| 1042 | Conyza canadensis | PPOX_B39_56 | gDNA Contig | 9626 | 9825 |
| 1043 | Conyza canadensis | PPOX_B39_56 | gDNA Contig | 9626 | 9825 |
| 1044 | Conyza canadensis | PPOX_B39_57 | gDNA Contig | 9801 | 10000 |
| 1045 | Conyza canadensis | PPOX_B39_57 | gDNA Contig | 9801 | 10000 |
| 1046 | Conyza canadensis | PPOX_B39_58 | gDNA Contig | 9976 | 10175 |
| 1047 | Conyza canadensis | PPOX_B39_58 | gDNA Contig | 9976 | 10175 |
| 1048 | Conyza canadensis | PPOX_B36_1 | cDNA Contig | 1 | 200 |
| 1049 | Conyza canadensis | PPOX_B36_1 | cDNA Contig | 1 | 200 |
| 1050 | Conyza canadensis | PPOX_B36_2 | cDNA Contig | 176 | 375 |
| 1051 | Conyza canadensis | PPOX_B36_2 | cDNA Contig | 176 | 375 |
| 1052 | Conyza canadensis | PPOX_B36_3 | cDNA Contig | 351 | 550 |
| 1053 | Conyza canadensis | PPOX_B36_3 | cDNA Contig | 351 | 550 |
| 1054 | Conyza canadensis | PPOX_B36_4 | cDNA Contig | 526 | 725 |
| 1055 | Conyza canadensis | PPOX_B36_4 | cDNA Contig | 526 | 725 |
| 1056 | Conyza canadensis | PPOX_B36_5 | cDNA Contig | 701 | 900 |
| 1057 | Conyza canadensis | PPOX_B36_5 | cDNA Contig | 701 | 900 |
| 1058 | Conyza canadensis | PPOX_B36_6 | cDNA Contig | 876 | 1075 |
| 1059 | Conyza canadensis | PPOX_B36_6 | cDNA Contig | 876 | 1075 |
| 1060 | Conyza canadensis | PPOX_B36_7 | cDNA Contig | 1051 | 1250 |
| 1061 | Conyza canadensis | PPOX_B36_7 | cDNA Contig | 1051 | 1250 |
| 1062 | Conyza canadensis | PPOX_B36_8 | cDNA Contig | 1226 | 1425 |
| 1063 | Conyza canadensis | PPOX_B36_8 | cDNA Contig | 1226 | 1425 |
| 1064 | Conyza canadensis | PPOX_B36_9 | cDNA Contig | 1401 | 1600 |
| 1065 | Conyza canadensis | PPOX_B36_9 | cDNA Contig | 1401 | 1600 |
| 1066 | Conyza canadensis | PPOX_B40_1 | gDNA Contig | 1 | 200 |
| 1067 | Conyza canadensis | PPOX_B40_1 | gDNA Contig | 1 | 200 |
| 1068 | Conyza canadensis | PPOX_B40_2 | gDNA Contig | 176 | 375 |
| 1069 | Conyza canadensis | PPOX_B40_2 | gDNA Contig | 176 | 375 |
| 1070 | Conyza canadensis | PPOX_B40_3 | gDNA Contig | 351 | 550 |
| 1071 | Conyza canadensis | PPOX_B40_3 | gDNA Contig | 351 | 550 |
| 1072 | Conyza canadensis | PPOX_B40_4 | gDNA Contig | 526 | 725 |
| 1073 | Conyza canadensis | PPOX_B40_4 | gDNA Contig | 526 | 725 |
| 1074 | Conyza canadensis | PPOX_B40_5 | gDNA Contig | 701 | 900 |
| 1075 | Conyza canadensis | PPOX_B40_5 | gDNA Contig | 701 | 900 |
| 1076 | Conyza canadensis | PPOX_B40_6 | gDNA Contig | 876 | 1075 |
| 1077 | Conyza canadensis | PPOX_B40_6 | gDNA Contig | 876 | 1075 |
| 1078 | Conyza canadensis | PPOX_B40_7 | gDNA Contig | 1051 | 1250 |
| 1079 | Conyza canadensis | PPOX_B40_7 | gDNA Contig | 1051 | 1250 |
| 1080 | Conyza canadensis | PPOX_B40_8 | gDNA Contig | 1226 | 1425 |
| 1081 | Conyza canadensis | PPOX_B40_8 | gDNA Contig | 1226 | 1425 |
| 1082 | Conyza canadensis | PPOX_B40_9 | gDNA Contig | 1401 | 1600 |
| 1083 | Conyza canadensis | PPOX_B40_9 | gDNA Contig | 1401 | 1600 |
| 1084 | Conyza canadensis | PPOX_B40_10 | gDNA Contig | 1576 | 1775 |
| 1085 | Conyza canadensis | PPOX_B40_10 | gDNA Contig | 1576 | 1775 |
| 1086 | Conyza canadensis | PPOX_B40_11 | gDNA Contig | 1751 | 1950 |

TABLE 2-continued

| SEQ ID NO | Species | Name / Reference | Type | Start | End |
|---|---|---|---|---|---|
| 1087 | *Conyza canadensis* | PPOX_B40_11 | gDNA Contig | 1751 | 1950 |
| 1088 | *Conyza canadensis* | PPOX_B40_12 | gDNA Contig | 1926 | 2125 |
| 1089 | *Conyza canadensis* | PPOX_B40_12 | gDNA Contig | 1926 | 2125 |
| 1090 | *Conyza canadensis* | PPOX_B40_13 | gDNA Contig | 2101 | 2300 |
| 1091 | *Conyza canadensis* | PPOX_B40_13 | gDNA Contig | 2101 | 2300 |
| 1092 | *Conyza canadensis* | PPOX_B40_14 | gDNA Contig | 2276 | 2475 |
| 1093 | *Conyza canadensis* | PPOX_B40_14 | gDNA Contig | 2276 | 2475 |
| 1094 | *Conyza canadensis* | PPOX_B37_1 | cDNA Contig | 1 | 200 |
| 1095 | *Conyza canadensis* | PPOX_B37_1 | cDNA Contig | 1 | 200 |
| 1096 | *Conyza canadensis* | PPOX_B37_2 | cDNA Contig | 176 | 375 |
| 1097 | *Conyza canadensis* | PPOX_B37_2 | cDNA Contig | 176 | 375 |
| 1098 | *Conyza canadensis* | PPOX_B37_3 | cDNA Contig | 351 | 550 |
| 1099 | *Conyza canadensis* | PPOX_B37_3 | cDNA Contig | 351 | 550 |
| 1100 | *Digitaria sanguinalis* | PPOX_B54_1 | cDNA Contig | 1 | 200 |
| 1101 | *Digitaria sanguinalis* | PPOX_B54_1 | cDNA Contig | 1 | 200 |
| 1102 | *Digitaria sanguinalis* | PPOX_B54_2 | cDNA Contig | 176 | 375 |
| 1103 | *Digitaria sanguinalis* | PPOX_B54_2 | cDNA Contig | 176 | 375 |
| 1104 | *Digitaria sanguinalis* | PPOX_B56_1 | gDNA Contig | 1 | 200 |
| 1105 | *Digitaria sanguinalis* | PPOX_B56_1 | gDNA Contig | 1 | 200 |
| 1106 | *Digitaria sanguinalis* | PPOX_B56_2 | gDNA Contig | 176 | 375 |
| 1107 | *Digitaria sanguinalis* | PPOX_B56_2 | gDNA Contig | 176 | 375 |
| 1108 | *Digitaria sanguinalis* | PPOX_B56_3 | gDNA Contig | 351 | 550 |
| 1109 | *Digitaria sanguinalis* | PPOX_B56_3 | gDNA Contig | 351 | 550 |
| 1110 | *Digitaria sanguinalis* | PPOX_B56_4 | gDNA Contig | 526 | 725 |
| 1111 | *Digitaria sanguinalis* | PPOX_B56_4 | gDNA Contig | 526 | 725 |
| 1112 | *Digitaria sanguinalis* | PPOX_B56_5 | gDNA Contig | 701 | 900 |
| 1113 | *Digitaria sanguinalis* | PPOX_B56_5 | gDNA Contig | 701 | 900 |
| 1114 | *Digitaria sanguinalis* | PPOX_B56_6 | gDNA Contig | 876 | 1075 |
| 1115 | *Digitaria sanguinalis* | PPOX_B56_6 | gDNA Contig | 876 | 1075 |
| 1116 | *Digitaria sanguinalis* | PPOX_B56_7 | gDNA Contig | 1051 | 1250 |
| 1117 | *Digitaria sanguinalis* | PPOX_B56_7 | gDNA Contig | 1051 | 1250 |
| 1118 | *Digitaria sanguinalis* | PPOX_B56_8 | gDNA Contig | 1226 | 1425 |
| 1119 | *Digitaria sanguinalis* | PPOX_B56_8 | gDNA Contig | 1226 | 1425 |
| 1120 | *Digitaria sanguinalis* | PPOX_B56_9 | gDNA Contig | 1401 | 1600 |
| 1121 | *Digitaria sanguinalis* | PPOX_B56_9 | gDNA Contig | 1401 | 1600 |
| 1122 | *Digitaria sanguinalis* | PPOX_B56_10 | gDNA Contig | 1576 | 1775 |
| 1123 | *Digitaria sanguinalis* | PPOX_B56_10 | gDNA Contig | 1576 | 1775 |
| 1124 | *Digitaria sanguinalis* | PPOX_B56_11 | gDNA Contig | 1751 | 1950 |
| 1125 | *Digitaria sanguinalis* | PPOX_B56_11 | gDNA Contig | 1751 | 1950 |
| 1126 | *Digitaria sanguinalis* | PPOX_B56_12 | gDNA Contig | 1926 | 2125 |
| 1127 | *Digitaria sanguinalis* | PPOX_B56_12 | gDNA Contig | 1926 | 2125 |
| 1128 | *Digitaria sanguinalis* | PPOX_B56_13 | gDNA Contig | 2101 | 2300 |
| 1129 | *Digitaria sanguinalis* | PPOX_B56_13 | gDNA Contig | 2101 | 2300 |
| 1130 | *Digitaria sanguinalis* | PPOX_B56_14 | gDNA Contig | 2276 | 2475 |
| 1131 | *Digitaria sanguinalis* | PPOX_B56_14 | gDNA Contig | 2276 | 2475 |
| 1132 | *Digitaria sanguinalis* | PPOX_B56_15 | gDNA Contig | 2451 | 2650 |
| 1133 | *Digitaria sanguinalis* | PPOX_B56_15 | gDNA Contig | 2451 | 2650 |
| 1134 | *Digitaria sanguinalis* | PPOX_B53_1 | cDNA Contig | 1 | 200 |
| 1135 | *Digitaria sanguinalis* | PPOX_B53_1 | cDNA Contig | 1 | 200 |
| 1136 | *Digitaria sanguinalis* | PPOX_B53_2 | cDNA Contig | 176 | 375 |
| 1137 | *Digitaria sanguinalis* | PPOX_B53_2 | cDNA Contig | 176 | 375 |
| 1138 | *Digitaria sanguinalis* | PPOX_B53_3 | cDNA Contig | 351 | 550 |
| 1139 | *Digitaria sanguinalis* | PPOX_B53_3 | cDNA Contig | 351 | 550 |
| 1140 | *Digitaria sanguinalis* | PPOX_B53_4 | cDNA Contig | 526 | 725 |
| 1141 | *Digitaria sanguinalis* | PPOX_B53_4 | cDNA Contig | 526 | 725 |
| 1142 | *Digitaria sanguinalis* | PPOX_B57_1 | gDNA Contig | 1 | 200 |
| 1143 | *Digitaria sanguinalis* | PPOX_B57_1 | gDNA Contig | 1 | 200 |
| 1144 | *Digitaria sanguinalis* | PPOX_B57_2 | gDNA Contig | 176 | 375 |
| 1145 | *Digitaria sanguinalis* | PPOX_B57_2 | gDNA Contig | 176 | 375 |
| 1146 | *Digitaria sanguinalis* | PPOX_B57_3 | gDNA Contig | 351 | 550 |
| 1147 | *Digitaria sanguinalis* | PPOX_B57_3 | gDNA Contig | 351 | 550 |
| 1148 | *Digitaria sanguinalis* | PPOX_B57_4 | gDNA Contig | 526 | 725 |
| 1149 | *Digitaria sanguinalis* | PPOX_B57_4 | gDNA Contig | 526 | 725 |
| 1150 | *Digitaria sanguinalis* | PPOX_B57_5 | gDNA Contig | 701 | 900 |
| 1151 | *Digitaria sanguinalis* | PPOX_B57_5 | gDNA Contig | 701 | 900 |
| 1152 | *Digitaria sanguinalis* | PPOX_B57_6 | gDNA Contig | 876 | 1075 |
| 1153 | *Digitaria sanguinalis* | PPOX_B57_6 | gDNA Contig | 876 | 1075 |
| 1154 | *Digitaria sanguinalis* | PPOX_B55_1 | cDNA Contig | 1 | 200 |
| 1155 | *Digitaria sanguinalis* | PPOX_B55_1 | cDNA Contig | 1 | 200 |
| 1156 | *Digitaria sanguinalis* | PPOX_B55_2 | cDNA Contig | 176 | 375 |
| 1157 | *Digitaria sanguinalis* | PPOX_B55_2 | cDNA Contig | 176 | 375 |
| 1158 | *Euphorbia heterophylla* | PPOX_B47_1 | gDNA Contig | 1 | 121 |
| 1159 | *Euphorbia heterophylla* | PPOX_B47_1 | gDNA Contig | 1 | 121 |
| 1160 | *Euphorbia heterophylla* | PPOX_B42_1 | cDNA Contig | 1 | 200 |
| 1161 | *Euphorbia heterophylla* | PPOX_B42_1 | cDNA Contig | 1 | 200 |
| 1162 | *Euphorbia heterophylla* | PPOX_B42_2 | cDNA Contig | 176 | 375 |
| 1163 | *Euphorbia heterophylla* | PPOX_B42_2 | cDNA Contig | 176 | 375 |

TABLE 2-continued

| SEQ ID NO | Species | Name | Reference | Type | Start | End |
|---|---|---|---|---|
| 1164 | Euphorbia heterophylla | PPOX_B46_1 | gDNA Contig | 1 | 200 |
| 1165 | Euphorbia heterophylla | PPOX_B46_1 | gDNA Contig | 1 | 200 |
| 1166 | Euphorbia heterophylla | PPOX_B46_2 | gDNA Contig | 176 | 375 |
| 1167 | Euphorbia heterophylla | PPOX_B46_2 | gDNA Contig | 176 | 375 |
| 1168 | Euphorbia heterophylla | PPOX_B46_3 | gDNA Contig | 351 | 550 |
| 1169 | Euphorbia heterophylla | PPOX_B46_3 | gDNA Contig | 351 | 550 |
| 1170 | Euphorbia heterophylla | PPOX_B46_4 | gDNA Contig | 526 | 725 |
| 1171 | Euphorbia heterophylla | PPOX_B46_4 | gDNA Contig | 526 | 725 |
| 1172 | Euphorbia heterophylla | PPOX_B45_1 | gDNA Contig | 1 | 200 |
| 1173 | Euphorbia heterophylla | PPOX_B45_1 | gDNA Contig | 1 | 200 |
| 1174 | Euphorbia heterophylla | PPOX_B45_2 | gDNA Contig | 176 | 375 |
| 1175 | Euphorbia heterophylla | PPOX_B45_2 | gDNA Contig | 176 | 375 |
| 1176 | Euphorbia heterophylla | PPOX_B45_3 | gDNA Contig | 351 | 550 |
| 1177 | Euphorbia heterophylla | PPOX_B45_3 | gDNA Contig | 351 | 550 |
| 1178 | Euphorbia heterophylla | PPOX_B45_4 | gDNA Contig | 526 | 725 |
| 1179 | Euphorbia heterophylla | PPOX_B45_4 | gDNA Contig | 526 | 725 |
| 1180 | Euphorbia heterophylla | PPOX_B45_5 | gDNA Contig | 701 | 900 |
| 1181 | Euphorbia heterophylla | PPOX_B45_5 | gDNA Contig | 701 | 900 |
| 1182 | Euphorbia heterophylla | PPOX_B41_1 | cDNA Contig | 1 | 200 |
| 1183 | Euphorbia heterophylla | PPOX_B41_1 | cDNA Contig | 1 | 200 |
| 1184 | Euphorbia heterophylla | PPOX_B41_2 | cDNA Contig | 176 | 375 |
| 1185 | Euphorbia heterophylla | PPOX_B41_2 | cDNA Contig | 176 | 375 |
| 1186 | Euphorbia heterophylla | PPOX_B41_3 | cDNA Contig | 351 | 550 |
| 1187 | Euphorbia heterophylla | PPOX_B41_3 | cDNA Contig | 351 | 550 |
| 1188 | Euphorbia heterophylla | PPOX_B41_4 | cDNA Contig | 526 | 725 |
| 1189 | Euphorbia heterophylla | PPOX_B41_4 | cDNA Contig | 526 | 725 |
| 1190 | Euphorbia heterophylla | PPOX_B41_5 | cDNA Contig | 701 | 900 |
| 1191 | Euphorbia heterophylla | PPOX_B41_5 | cDNA Contig | 701 | 900 |
| 1192 | Euphorbia heterophylla | PPOX_B41_6 | cDNA Contig | 876 | 1075 |
| 1193 | Euphorbia heterophylla | PPOX_B41_6 | cDNA Contig | 876 | 1075 |
| 1194 | Euphorbia heterophylla | PPOX_B41_7 | cDNA Contig | 1051 | 1250 |
| 1195 | Euphorbia heterophylla | PPOX_B41_7 | cDNA Contig | 1051 | 1250 |
| 1196 | Euphorbia heterophylla | PPOX_B41_8 | cDNA Contig | 1226 | 1425 |
| 1197 | Euphorbia heterophylla | PPOX_B41_8 | cDNA Contig | 1226 | 1425 |
| 1198 | Euphorbia heterophylla | PPOX_B41_9 | cDNA Contig | 1401 | 1600 |
| 1199 | Euphorbia heterophylla | PPOX_B41_9 | cDNA Contig | 1401 | 1600 |
| 1200 | Euphorbia heterophylla | PPOX_B44_1 | gDNA Contig | 1 | 200 |
| 1201 | Euphorbia heterophylla | PPOX_B44_1 | gDNA Contig | 1 | 200 |
| 1202 | Euphorbia heterophylla | PPOX_B44_2 | gDNA Contig | 176 | 375 |
| 1203 | Euphorbia heterophylla | PPOX_B44_2 | gDNA Contig | 176 | 375 |
| 1204 | Euphorbia heterophylla | PPOX_B44_3 | gDNA Contig | 351 | 550 |
| 1205 | Euphorbia heterophylla | PPOX_B44_3 | gDNA Contig | 351 | 550 |
| 1206 | Euphorbia heterophylla | PPOX_B44_4 | gDNA Contig | 526 | 725 |
| 1207 | Euphorbia heterophylla | PPOX_B44_4 | gDNA Contig | 526 | 725 |
| 1208 | Euphorbia heterophylla | PPOX_B44_5 | gDNA Contig | 701 | 900 |
| 1209 | Euphorbia heterophylla | PPOX_B44_5 | gDNA Contig | 701 | 900 |
| 1210 | Euphorbia heterophylla | PPOX_B44_6 | gDNA Contig | 876 | 1075 |
| 1211 | Euphorbia heterophylla | PPOX_B44_6 | gDNA Contig | 876 | 1075 |
| 1212 | Euphorbia heterophylla | PPOX_B44_7 | gDNA Contig | 1051 | 1250 |
| 1213 | Euphorbia heterophylla | PPOX_B44_7 | gDNA Contig | 1051 | 1250 |
| 1214 | Euphorbia heterophylla | PPOX_B44_8 | gDNA Contig | 1226 | 1425 |
| 1215 | Euphorbia heterophylla | PPOX_B44_8 | gDNA Contig | 1226 | 1425 |
| 1216 | Euphorbia heterophylla | PPOX_B44_9 | gDNA Contig | 1401 | 1600 |
| 1217 | Euphorbia heterophylla | PPOX_B44_9 | gDNA Contig | 1401 | 1600 |
| 1218 | Euphorbia heterophylla | PPOX_B44_10 | gDNA Contig | 1576 | 1775 |
| 1219 | Euphorbia heterophylla | PPOX_B44_10 | gDNA Contig | 1576 | 1775 |
| 1220 | Euphorbia heterophylla | PPOX_B44_11 | gDNA Contig | 1751 | 1950 |
| 1221 | Euphorbia heterophylla | PPOX_B44_11 | gDNA Contig | 1751 | 1950 |
| 1222 | Euphorbia heterophylla | PPOX_B44_12 | gDNA Contig | 1926 | 2125 |
| 1223 | Euphorbia heterophylla | PPOX_B44_12 | gDNA Contig | 1926 | 2125 |
| 1224 | Euphorbia heterophylla | PPOX_B44_13 | gDNA Contig | 2101 | 2300 |
| 1225 | Euphorbia heterophylla | PPOX_B44_13 | gDNA Contig | 2101 | 2300 |
| 1226 | Euphorbia heterophylla | PPOX_B44_14 | gDNA Contig | 2276 | 2475 |
| 1227 | Euphorbia heterophylla | PPOX_B44_14 | gDNA Contig | 2276 | 2475 |
| 1228 | Euphorbia heterophylla | PPOX_B43_1 | gDNA Contig | 1 | 200 |
| 1229 | Euphorbia heterophylla | PPOX_B43_1 | gDNA Contig | 1 | 200 |
| 1230 | Euphorbia heterophylla | PPOX_B43_2 | gDNA Contig | 176 | 375 |
| 1231 | Euphorbia heterophylla | PPOX_B43_2 | gDNA Contig | 176 | 375 |
| 1232 | Euphorbia heterophylla | PPOX_B43_3 | gDNA Contig | 351 | 550 |
| 1233 | Euphorbia heterophylla | PPOX_B43_3 | gDNA Contig | 351 | 550 |
| 1234 | Euphorbia heterophylla | PPOX_B43_4 | gDNA Contig | 526 | 725 |
| 1235 | Euphorbia heterophylla | PPOX_B43_4 | gDNA Contig | 526 | 725 |
| 1236 | Euphorbia heterophylla | PPOX_B43_5 | gDNA Contig | 701 | 900 |
| 1237 | Euphorbia heterophylla | PPOX_B43_5 | gDNA Contig | 701 | 900 |
| 1238 | Euphorbia heterophylla | PPOX_B43_6 | gDNA Contig | 876 | 1075 |
| 1239 | Euphorbia heterophylla | PPOX_B43_6 | gDNA Contig | 876 | 1075 |
| 1240 | Euphorbia heterophylla | PPOX_B43_7 | gDNA Contig | 1051 | 1250 |

TABLE 2-continued

| SEQ ID NO | Species | Name \| Reference | Type | Start | End |
|---|---|---|---|---|---|
| 1241 | Euphorbia heterophylla | PPOX_B43_7 | gDNA Contig | 1051 | 1250 |
| 1242 | Euphorbia heterophylla | PPOX_B43_8 | gDNA Contig | 1226 | 1425 |
| 1243 | Euphorbia heterophylla | PPOX_B43_8 | gDNA Contig | 1226 | 1425 |
| 1244 | Euphorbia heterophylla | PPOX_B43_9 | gDNA Contig | 1401 | 1600 |
| 1245 | Euphorbia heterophylla | PPOX_B43_9 | gDNA Contig | 1401 | 1600 |
| 1246 | Euphorbia heterophylla | PPOX_B43_10 | gDNA Contig | 1576 | 1775 |
| 1247 | Euphorbia heterophylla | PPOX_B43_10 | gDNA Contig | 1576 | 1775 |
| 1248 | Euphorbia heterophylla | PPOX_B43_11 | gDNA Contig | 1751 | 1950 |
| 1249 | Euphorbia heterophylla | PPOX_B43_11 | gDNA Contig | 1751 | 1950 |
| 1250 | Euphorbia heterophylla | PPOX_B43_12 | gDNA Contig | 1926 | 2125 |
| 1251 | Euphorbia heterophylla | PPOX_B43_12 | gDNA Contig | 1926 | 2125 |
| 1252 | Euphorbia heterophylla | PPOX_B43_13 | gDNA Contig | 2101 | 2300 |
| 1253 | Euphorbia heterophylla | PPOX_B43_13 | gDNA Contig | 2101 | 2300 |
| 1254 | Euphorbia heterophylla | PPOX_B43_14 | gDNA Contig | 2276 | 2475 |
| 1255 | Euphorbia heterophylla | PPOX_B43_14 | gDNA Contig | 2276 | 2475 |
| 1256 | Euphorbia heterophylla | PPOX_B43_15 | gDNA Contig | 2451 | 2650 |
| 1257 | Euphorbia heterophylla | PPOX_B43_15 | gDNA Contig | 2451 | 2650 |
| 1258 | Euphorbia heterophylla | PPOX_B43_16 | gDNA Contig | 2626 | 2825 |
| 1259 | Euphorbia heterophylla | PPOX_B43_16 | gDNA Contig | 2626 | 2825 |
| 1260 | Euphorbia heterophylla | PPOX_B43_17 | gDNA Contig | 2801 | 3000 |
| 1261 | Euphorbia heterophylla | PPOX_B43_17 | gDNA Contig | 2801 | 3000 |
| 1262 | Euphorbia heterophylla | PPOX_B43_18 | gDNA Contig | 2976 | 3175 |
| 1263 | Euphorbia heterophylla | PPOX_B43_18 | gDNA Contig | 2976 | 3175 |
| 1264 | Euphorbia heterophylla | PPOX_B43_19 | gDNA Contig | 3151 | 3350 |
| 1265 | Euphorbia heterophylla | PPOX_B43_19 | gDNA Contig | 3151 | 3350 |
| 1266 | Euphorbia heterophylla | PPOX_B43_20 | gDNA Contig | 3326 | 3525 |
| 1267 | Euphorbia heterophylla | PPOX_B43_20 | gDNA Contig | 3326 | 3525 |
| 1268 | Euphorbia heterophylla | PPOX_B43_21 | gDNA Contig | 3501 | 3700 |
| 1269 | Euphorbia heterophylla | PPOX_B43_21 | gDNA Contig | 3501 | 3700 |
| 1270 | Euphorbia heterophylla | PPOX_B43_22 | gDNA Contig | 3676 | 3875 |
| 1271 | Euphorbia heterophylla | PPOX_B43_22 | gDNA Contig | 3676 | 3875 |
| 1272 | Euphorbia heterophylla | PPOX_B43_23 | gDNA Contig | 3851 | 4050 |
| 1273 | Euphorbia heterophylla | PPOX_B43_23 | gDNA Contig | 3851 | 4050 |
| 1274 | Euphorbia heterophylla | PPOX_B48_1 | gDNA Contig | 1 | 77 |
| 1275 | Euphorbia heterophylla | PPOX_B48_1 | gDNA Contig | 1 | 77 |
| 1276 | Kochia scoparia | PPOX_B58_1 | cDNA Contig | 1 | 200 |
| 1277 | Kochia scoparia | PPOX_B58_1 | cDNA Contig | 1 | 200 |
| 1278 | Kochia scoparia | PPOX_B58_2 | cDNA Contig | 176 | 375 |
| 1279 | Kochia scoparia | PPOX_B58_2 | cDNA Contig | 176 | 375 |
| 1280 | Kochia scoparia | PPOX_B58_3 | cDNA Contig | 351 | 550 |
| 1281 | Kochia scoparia | PPOX_B58_3 | cDNA Contig | 351 | 550 |
| 1282 | Kochia scoparia | PPOX_B58_4 | cDNA Contig | 526 | 725 |
| 1283 | Kochia scoparia | PPOX_B58_4 | cDNA Contig | 526 | 725 |
| 1284 | Kochia scoparia | PPOX_B58_5 | cDNA Contig | 701 | 900 |
| 1285 | Kochia scoparia | PPOX_B58_5 | cDNA Contig | 701 | 900 |
| 1286 | Kochia scoparia | PPOX_B58_6 | cDNA Contig | 876 | 1075 |
| 1287 | Kochia scoparia | PPOX_B58_6 | cDNA Contig | 876 | 1075 |
| 1288 | Kochia scoparia | PPOX_B58_7 | cDNA Contig | 1051 | 1250 |
| 1289 | Kochia scoparia | PPOX_B58_7 | cDNA Contig | 1051 | 1250 |
| 1290 | Kochia scoparia | PPOX_B58_8 | cDNA Contig | 1226 | 1425 |
| 1291 | Kochia scoparia | PPOX_B58_8 | cDNA Contig | 1226 | 1425 |
| 1292 | Kochia scoparia | PPOX_B59_1 | cDNA Contig | 1 | 200 |
| 1293 | Kochia scoparia | PPOX_B59_1 | cDNA Contig | 1 | 200 |
| 1294 | Kochia scoparia | PPOX_B59_2 | cDNA Contig | 176 | 375 |
| 1295 | Kochia scoparia | PPOX_B59_2 | cDNA Contig | 176 | 375 |
| 1296 | Kochia scoparia | PPOX_B59_3 | cDNA Contig | 351 | 550 |
| 1297 | Kochia scoparia | PPOX_B59_3 | cDNA Contig | 351 | 550 |
| 1298 | Kochia scoparia | PPOX_B59_4 | cDNA Contig | 526 | 725 |
| 1299 | Kochia scoparia | PPOX_B59_4 | cDNA Contig | 526 | 725 |
| 1300 | Kochia scoparia | PPOX_B59_5 | cDNA Contig | 701 | 900 |
| 1301 | Kochia scoparia | PPOX_B59_5 | cDNA Contig | 701 | 900 |
| 1302 | Kochia scoparia | PPOX_B60_1 | cDNA Contig | 1 | 200 |
| 1303 | Kochia scoparia | PPOX_B60_1 | cDNA Contig | 1 | 200 |
| 1304 | Kochia scoparia | PPOX_B60_2 | cDNA Contig | 176 | 375 |
| 1305 | Kochia scoparia | PPOX_B60_2 | cDNA Contig | 176 | 375 |
| 1306 | Kochia scoparia | PPOX_B60_3 | cDNA Contig | 351 | 550 |
| 1307 | Kochia scoparia | PPOX_B60_3 | cDNA Contig | 351 | 550 |
| 1308 | Kochia scoparia | PPOX_B61_1 | cDNA Contig | 1 | 200 |
| 1309 | Kochia scoparia | PPOX_B61_1 | cDNA Contig | 1 | 200 |
| 1310 | Kochia scoparia | PPOX_B61_2 | cDNA Contig | 176 | 375 |
| 1311 | Kochia scoparia | PPOX_B61_2 | cDNA Contig | 176 | 375 |
| 1312 | Lolium multiflorum | PPOX_B65_1 | cDNA Contig | 1 | 150 |
| 1313 | Lolium multiflorum | PPOX_B65_1 | cDNA Contig | 1 | 150 |
| 1314 | Lolium multiflorum | PPOX_B68_1 | cDNA Contig | 1 | 108 |
| 1315 | Lolium multiflorum | PPOX_B68_1 | cDNA Contig | 1 | 108 |
| 1316 | Lolium multiflorum | PPOX_B66_1 | cDNA Contig | 1 | 144 |
| 1317 | Lolium multiflorum | PPOX_B66_1 | cDNA Contig | 1 | 144 |

TABLE 2-continued

| SEQ ID NO | Species | Name / Reference | Type | Start | End |
|---|---|---|---|---|---|
| 1318 | Lolium multiflorum | PPOX_B67_1 | cDNA Contig | 1 | 114 |
| 1319 | Lolium multiflorum | PPOX_B67_1 | cDNA Contig | 1 | 114 |
| 1320 | Lolium multiflorum | PPOX_B69_1 | gDNA Contig | 1 | 200 |
| 1321 | Lolium multiflorum | PPOX_B69_1 | gDNA Contig | 1 | 200 |
| 1322 | Lolium multiflorum | PPOX_B69_2 | gDNA Contig | 176 | 375 |
| 1323 | Lolium multiflorum | PPOX_B69_2 | gDNA Contig | 176 | 375 |
| 1324 | Lolium multiflorum | PPOX_B69_3 | gDNA Contig | 351 | 550 |
| 1325 | Lolium multiflorum | PPOX_B69_3 | gDNA Contig | 351 | 550 |
| 1326 | Lolium multiflorum | PPOX_B69_4 | gDNA Contig | 526 | 725 |
| 1327 | Lolium multiflorum | PPOX_B69_4 | gDNA Contig | 526 | 725 |
| 1328 | Lolium multiflorum | PPOX_B69_5 | gDNA Contig | 701 | 900 |
| 1329 | Lolium multiflorum | PPOX_B69_5 | gDNA Contig | 701 | 900 |
| 1330 | Lolium multiflorum | PPOX_B69_6 | gDNA Contig | 876 | 1075 |
| 1331 | Lolium multiflorum | PPOX_B69_6 | gDNA Contig | 876 | 1075 |
| 1332 | Lolium multiflorum | PPOX_B69_7 | gDNA Contig | 1051 | 1250 |
| 1333 | Lolium multiflorum | PPOX_B69_7 | gDNA Contig | 1051 | 1250 |
| 1334 | Lolium multiflorum | PPOX_B69_8 | gDNA Contig | 1226 | 1425 |
| 1335 | Lolium multiflorum | PPOX_B69_8 | gDNA Contig | 1226 | 1425 |
| 1336 | Lolium multiflorum | PPOX_B69_9 | gDNA Contig | 1401 | 1600 |
| 1337 | Lolium multiflorum | PPOX_B69_9 | gDNA Contig | 1401 | 1600 |
| 1338 | Lolium multiflorum | PPOX_B69_10 | gDNA Contig | 1576 | 1775 |
| 1339 | Lolium multiflorum | PPOX_B69_10 | gDNA Contig | 1576 | 1775 |
| 1340 | Lolium multiflorum | PPOX_B69_11 | gDNA Contig | 1751 | 1950 |
| 1341 | Lolium multiflorum | PPOX_B69_11 | gDNA Contig | 1751 | 1950 |
| 1342 | Lolium multiflorum | PPOX_B69_12 | gDNA Contig | 1926 | 2125 |
| 1343 | Lolium multiflorum | PPOX_B69_12 | gDNA Contig | 1926 | 2125 |
| 1344 | Lolium multiflorum | PPOX_B69_13 | gDNA Contig | 2101 | 2300 |
| 1345 | Lolium multiflorum | PPOX_B69_13 | gDNA Contig | 2101 | 2300 |
| 1346 | Lolium multiflorum | PPOX_B69_14 | gDNA Contig | 2276 | 2475 |
| 1347 | Lolium multiflorum | PPOX_B69_14 | gDNA Contig | 2276 | 2475 |
| 1348 | Lolium multiflorum | PPOX_B69_15 | gDNA Contig | 2451 | 2650 |
| 1349 | Lolium multiflorum | PPOX_B69_15 | gDNA Contig | 2451 | 2650 |
| 1350 | Lolium multiflorum | PPOX_B69_16 | gDNA Contig | 2626 | 2825 |
| 1351 | Lolium multiflorum | PPOX_B69_16 | gDNA Contig | 2626 | 2825 |
| 1352 | Lolium multiflorum | PPOX_B69_17 | gDNA Contig | 2801 | 3000 |
| 1353 | Lolium multiflorum | PPOX_B69_17 | gDNA Contig | 2801 | 3000 |
| 1354 | Lolium multiflorum | PPOX_B62_1 | cDNA Contig | 1 | 200 |
| 1355 | Lolium multiflorum | PPOX_B62_1 | cDNA Contig | 1 | 200 |
| 1356 | Lolium multiflorum | PPOX_B62_2 | cDNA Contig | 176 | 375 |
| 1357 | Lolium multiflorum | PPOX_B62_2 | cDNA Contig | 176 | 375 |
| 1358 | Lolium multiflorum | PPOX_B62_3 | cDNA Contig | 351 | 550 |
| 1359 | Lolium multiflorum | PPOX_B62_3 | cDNA Contig | 351 | 550 |
| 1360 | Lolium multiflorum | PPOX_B62_4 | cDNA Contig | 526 | 725 |
| 1361 | Lolium multiflorum | PPOX_B62_4 | cDNA Contig | 526 | 725 |
| 1362 | Lolium multiflorum | PPOX_B62_5 | cDNA Contig | 701 | 900 |
| 1363 | Lolium multiflorum | PPOX_B62_5 | cDNA Contig | 701 | 900 |
| 1364 | Lolium multiflorum | PPOX_B62_6 | cDNA Contig | 876 | 1075 |
| 1365 | Lolium multiflorum | PPOX_B62_6 | cDNA Contig | 876 | 1075 |
| 1366 | Lolium multiflorum | PPOX_B70_1 | gDNA Contig | 1 | 200 |
| 1367 | Lolium multiflorum | PPOX_B70_1 | gDNA Contig | 1 | 200 |
| 1368 | Lolium multiflorum | PPOX_B70_2 | gDNA Contig | 176 | 375 |
| 1369 | Lolium multiflorum | PPOX_B70_2 | gDNA Contig | 176 | 375 |
| 1370 | Lolium multiflorum | PPOX_B70_3 | gDNA Contig | 351 | 550 |
| 1371 | Lolium multiflorum | PPOX_B70_3 | gDNA Contig | 351 | 550 |
| 1372 | Lolium multiflorum | PPOX_B70_4 | gDNA Contig | 526 | 725 |
| 1373 | Lolium multiflorum | PPOX_B70_4 | gDNA Contig | 526 | 725 |
| 1374 | Lolium multiflorum | PPOX_B71_1 | gDNA Contig | 1 | 200 |
| 1375 | Lolium multiflorum | PPOX_B71_1 | gDNA Contig | 1 | 200 |
| 1376 | Lolium multiflorum | PPOX_B71_2 | gDNA Contig | 176 | 375 |
| 1377 | Lolium multiflorum | PPOX_B71_2 | gDNA Contig | 176 | 375 |
| 1378 | Lolium multiflorum | PPOX_B63_1 | cDNA Contig | 1 | 200 |
| 1379 | Lolium multiflorum | PPOX_B63_1 | cDNA Contig | 1 | 200 |
| 1380 | Lolium multiflorum | PPOX_B64_1 | cDNA Contig | 1 | 200 |
| 1381 | Lolium multiflorum | PPOX_B64_1 | cDNA Contig | 1 | 200 |

The gene sequences and fragments of Table 1 were compared and 21-mers of contiguous polynucleotides were identified that had homology across the various PPG oxidase gene sequences. The purpose is to identify trigger molecules that are useful as herbicidal molecules or in combination with a PPG oxidase inhibitor herbicide across a broad range of weed species. The sequences shown in Table 3 represent the 21-mers that were present in the PPG oxidase gene of at least eight of the weed species of Table 1. It is contemplated that additional 21-mers can be selected from the sequences of Table 1 that are specific for a single weed species or a few weeds species within a genus or trigger molecules that are at least 18 contiguous nucleotides, at least 19 contiguous nucleotides, at least 20 contiguous nucleotides or at least 21 contiguous nucleotides in length and at least 85 percent identical to a PPG oxidase gene sequence selected from the group consisting of SEQ ID NOs:1-71 or fragment thereof.

By this method, it is possible to identify an oligonucleotide or several oligonucleotides that are the most efficacious trigger molecule to effect plant sensitivity to PPG oxidase inhibitor or modulation of PPG oxidase gene expression. The modulation of PPG oxidase gene expression is determined by the detection of PPG oxidase siRNA molecules specific to PPG oxidase gene or by an observation of a reduction in the amount of PPG oxidase RNA transcript produced relative to an untreated plant. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the PPG oxidase gene and the assembled contigs as set forth in SEQ ID Nos: 1-71 were divided into fragments as shown in Table 3 below and as set forth in SEQ ID NOs 1382-2221.

TABLE 3

| SEQ ID NO | Gene | #Species | Species |
|---|---|---|---|
| 1382 | PPOX | 10 | *Amaranthus albus, Amaranthus graecizans, Amaranthus hybridus, Amaranthus. Lividus, Amaranthus palmeri, Amaranthus rudis, Amaranthus spinosus, Amaranthus thunbergii, Amaranthus viridis* ("*Amaranthus* sp."), *Commelina diffusa* |
| 1383 | PPOX | 10 | *Amaranthus* sp., *Chenopodium album* |
| 1384 | PPOX | 10 | *Amaranthus* sp., *Chenopodium album* |
| 1385 | PPOX | 10 | *Amaranthus* sp., *Commelina diffusa* |
| 1386 | PPOX | 10 | *Amaranthus* sp., *Chenopodium album* |
| 1387 | PPOX | 10 | *Amaranthus* sp., *Chenopodium album* |
| 1388 | PPOX | 10 | *Amaranthus* sp., *Chenopodium album* |
| 1389 | PPOX | 10 | *Amaranthus* sp., *Commelina diffusa* |
| 1390 | PPOX | 10 | *Amaranthus* sp., *Chenopodium album* |
| 1391 | PPOX | 10 | *Amaranthus* sp., *Chenopodium album* |
| 1392 | PPOX | 10 | *Amaranthus* sp., *Chenopodium album* |
| 1393 | PPOX | 10 | *Amaranthus* sp., *Chenopodium album* |
| 1394 | PPOX | 10 | *Amaranthus* sp., *Commelina diffusa* |
| 1395 | PPOX | 10 | *Amaranthus* sp., *Chenopodium album* |
| 1396 | PPOX | 9 | *Amaranthus* sp. |
| 1397 | PPOX | 9 | *Amaranthus* sp. |
| 1398 | PPOX | 9 | *Amaranthus* sp. |
| 1399 | PPOX | 9 | *Amaranthus* sp. |
| 1400 | PPOX | 9 | *Amaranthus* sp. |
| 1401 | PPOX | 9 | *Amaranthus* sp. |
| 1402 | PPOX | 9 | *Amaranthus* sp. |
| 1403 | PPOX | 9 | *Amaranthus* sp. |
| 1404 | PPOX | 9 | *Amaranthus* sp. |
| 1405 | PPOX | 9 | *Amaranthus* sp. |
| 1406 | PPOX | 9 | *Amaranthus* sp. |
| 1407 | PPOX | 9 | *Amaranthus* sp. |
| 1408 | PPOX | 9 | *Amaranthus* sp. |
| 1409 | PPOX | 9 | *Amaranthus* sp. |
| 1410 | PPOX | 9 | *Amaranthus* sp. |
| 1411 | PPOX | 9 | *Amaranthus* sp. |
| 1412 | PPOX | 9 | *Amaranthus* sp. |
| 1413 | PPOX | 9 | *Amaranthus* sp. |
| 1414 | PPOX | 9 | *Amaranthus* sp. |
| 1415 | PPOX | 9 | *Amaranthus* sp. |
| 1416 | PPOX | 9 | *Amaranthus* sp. |
| 1417 | PPOX | 9 | *Amaranthus* sp. |
| 1418 | PPOX | 9 | *Amaranthus* sp. |
| 1419 | PPOX | 9 | *Amaranthus* sp. |
| 1420 | PPOX | 9 | *Amaranthus* sp. |
| 1421 | PPOX | 9 | *Amaranthus* sp. |
| 1422 | PPOX | 9 | *Amaranthus* sp. |
| 1423 | PPOX | 9 | *Amaranthus* sp. |
| 1424 | PPOX | 9 | *Amaranthus* sp. |
| 1425 | PPOX | 9 | *Amaranthus* sp. |
| 1426 | PPOX | 9 | *Amaranthus* sp. |
| 1427 | PPOX | 9 | *Amaranthus* sp. |
| 1428 | PPOX | 9 | *Amaranthus* sp. |
| 1429 | PPOX | 9 | *Amaranthus* sp. |
| 1430 | PPOX | 9 | *Amaranthus* sp. |
| 1431 | PPOX | 9 | *Amaranthus* sp. |
| 1432 | PPOX | 9 | *Amaranthus* sp. |
| 1433 | PPOX | 9 | *Amaranthus* sp. |
| 1434 | PPOX | 9 | *Amaranthus* sp. |
| 1435 | PPOX | 9 | *Amaranthus* sp. |
| 1436 | PPOX | 9 | *Amaranthus* sp. |
| 1437 | PPOX | 9 | *Amaranthus* sp. |
| 1438 | PPOX | 9 | *Amaranthus* sp. |
| 1439 | PPOX | 9 | *Amaranthus* sp. |
| 1440 | PPOX | 9 | *Amaranthus* sp. |
| 1441 | PPOX | 9 | *Amaranthus* sp. |
| 1442 | PPOX | 9 | *Amaranthus* sp. |
| 1443 | PPOX | 9 | *Amaranthus* sp. |
| 1444 | PPOX | 9 | *Amaranthus* sp. |
| 1445 | PPOX | 9 | *Amaranthus* sp. |
| 1446 | PPOX | 9 | *Amaranthus* sp. |
| 1447 | PPOX | 9 | *Amaranthus* sp. |
| 1448 | PPOX | 9 | *Amaranthus* sp. |
| 1449 | PPOX | 9 | *Amaranthus* sp. |
| 1450 | PPOX | 9 | *Amaranthus* sp. |
| 1451 | PPOX | 9 | *Amaranthus* sp. |
| 1452 | PPOX | 9 | *Amaranthus* sp. |
| 1453 | PPOX | 9 | *Amaranthus* sp. |
| 1454 | PPOX | 9 | *Amaranthus* sp. |
| 1455 | PPOX | 9 | *Amaranthus* sp. |
| 1456 | PPOX | 9 | *Amaranthus* sp. |
| 1457 | PPOX | 9 | *Amaranthus* sp. |
| 1458 | PPOX | 9 | *Amaranthus* sp. |
| 1459 | PPOX | 9 | *Amaranthus* sp. |
| 1460 | PPOX | 9 | *Amaranthus* sp. |
| 1461 | PPOX | 9 | *Amaranthus* sp. |
| 1462 | PPOX | 9 | *Amaranthus* sp. |
| 1463 | PPOX | 9 | *Amaranthus* sp. |
| 1464 | PPOX | 9 | *Amaranthus* sp. |
| 1465 | PPOX | 9 | *Amaranthus* sp. |
| 1466 | PPOX | 9 | *Amaranthus* sp. |
| 1467 | PPOX | 9 | *Amaranthus* sp. |
| 1468 | PPOX | 9 | *Amaranthus* sp. |
| 1469 | PPOX | 9 | *Amaranthus* sp. |
| 1470 | PPOX | 9 | *Amaranthus* sp. |
| 1471 | PPOX | 9 | *Amaranthus* sp. |
| 1472 | PPOX | 9 | *Amaranthus* sp. |
| 1473 | PPOX | 9 | *Amaranthus* sp. |
| 1474 | PPOX | 9 | *Amaranthus* sp. |
| 1475 | PPOX | 9 | *Amaranthus* sp. |
| 1476 | PPOX | 9 | *Amaranthus* sp. |
| 1477 | PPOX | 9 | *Amaranthus* sp. |
| 1478 | PPOX | 9 | *Amaranthus* sp. |
| 1479 | PPOX | 9 | *Amaranthus* sp. |
| 1480 | PPOX | 9 | *Amaranthus* sp. |
| 1481 | PPOX | 9 | *Amaranthus* sp. |
| 1482 | PPOX | 9 | *Amaranthus* sp. |
| 1483 | PPOX | 9 | *Amaranthus* sp. |
| 1484 | PPOX | 9 | *Amaranthus* sp. |
| 1485 | PPOX | 9 | *Amaranthus* sp. |
| 1486 | PPOX | 9 | *Amaranthus* sp. |
| 1487 | PPOX | 9 | *Amaranthus* sp. |
| 1488 | PPOX | 9 | *Amaranthus* sp. |
| 1489 | PPOX | 9 | *Amaranthus* sp. |
| 1490 | PPOX | 9 | *Amaranthus* sp. |
| 1491 | PPOX | 9 | *Amaranthus* sp. |
| 1492 | PPOX | 9 | *Amaranthus* sp. |
| 1493 | PPOX | 9 | *Amaranthus* sp. |
| 1494 | PPOX | 9 | *Amaranthus* sp. |
| 1495 | PPOX | 9 | *Amaranthus* sp. |
| 1496 | PPOX | 9 | *Amaranthus* sp. |
| 1497 | PPOX | 9 | *Amaranthus* sp. |
| 1498 | PPOX | 9 | *Amaranthus* sp. |
| 1499 | PPOX | 9 | *Amaranthus* sp. |
| 1500 | PPOX | 9 | *Amaranthus* sp. |
| 1501 | PPOX | 9 | *Amaranthus* sp. |
| 1502 | PPOX | 9 | *Amaranthus* sp. |
| 1503 | PPOX | 9 | *Amaranthus* sp. |
| 1504 | PPOX | 9 | *Amaranthus* sp. |
| 1505 | PPOX | 9 | *Amaranthus* sp. |
| 1506 | PPOX | 9 | *Amaranthus* sp. |

TABLE 3-continued

| SEQ ID NO | Gene | #Species | Species |
|---|---|---|---|
| 1507 | PPOX | 9 | *Amaranthus* sp. |
| 1508 | PPOX | 9 | *Amaranthus* sp. |
| 1509 | PPOX | 9 | *Amaranthus* sp. |
| 1510 | PPOX | 9 | *Amaranthus* sp. |
| 1511 | PPOX | 9 | *Amaranthus* sp. |
| 1512 | PPOX | 9 | *Amaranthus* sp. |
| 1513 | PPOX | 9 | *Amaranthus* sp. |
| 1514 | PPOX | 9 | *Amaranthus* sp. |
| 1515 | PPOX | 9 | *Amaranthus* sp. |
| 1516 | PPOX | 9 | *Amaranthus* sp. |
| 1517 | PPOX | 9 | *Amaranthus* sp. |
| 1518 | PPOX | 9 | *Amaranthus* sp. |
| 1519 | PPOX | 9 | *Amaranthus* sp. |
| 1520 | PPOX | 9 | *Amaranthus* sp. |
| 1521 | PPOX | 9 | *Amaranthus* sp. |
| 1522 | PPOX | 9 | *Amaranthus* sp. |
| 1523 | PPOX | 9 | *Amaranthus* sp. |
| 1524 | PPOX | 9 | *Amaranthus* sp. |
| 1525 | PPOX | 9 | *Amaranthus* sp. |
| 1526 | PPOX | 9 | *Amaranthus* sp. |
| 1527 | PPOX | 9 | *Amaranthus* sp. |
| 1528 | PPOX | 9 | *Amaranthus* sp. |
| 1529 | PPOX | 9 | *Amaranthus* sp. |
| 1530 | PPOX | 9 | *Amaranthus* sp. |
| 1531 | PPOX | 9 | *Amaranthus* sp. |
| 1532 | PPOX | 9 | *Amaranthus* sp. |
| 1533 | PPOX | 9 | *Amaranthus* sp. |
| 1534 | PPOX | 9 | *Amaranthus* sp. |
| 1535 | PPOX | 9 | *Amaranthus* sp. |
| 1536 | PPOX | 9 | *Amaranthus* sp. |
| 1537 | PPOX | 9 | *Amaranthus* sp. |
| 1538 | PPOX | 9 | *Amaranthus* sp. |
| 1539 | PPOX | 9 | *Amaranthus* sp. |
| 1540 | PPOX | 9 | *Amaranthus* sp. |
| 1541 | PPOX | 9 | *Amaranthus* sp. |
| 1542 | PPOX | 9 | *Amaranthus* sp. |
| 1543 | PPOX | 9 | *Amaranthus* sp. |
| 1544 | PPOX | 9 | *Amaranthus* sp. |
| 1545 | PPOX | 9 | *Amaranthus* sp. |
| 1546 | PPOX | 9 | *Amaranthus* sp. |
| 1547 | PPOX | 9 | *Amaranthus* sp. |
| 1548 | PPOX | 9 | *Amaranthus* sp. |
| 1549 | PPOX | 9 | *Amaranthus* sp. |
| 1550 | PPOX | 9 | *Amaranthus* sp. |
| 1551 | PPOX | 9 | *Amaranthus* sp. |
| 1552 | PPOX | 9 | *Amaranthus* sp. |
| 1553 | PPOX | 9 | *Amaranthus* sp. |
| 1554 | PPOX | 9 | *Amaranthus* sp. |
| 1555 | PPOX | 9 | *Amaranthus* sp. |
| 1556 | PPOX | 9 | *Amaranthus* sp. |
| 1557 | PPOX | 9 | *Amaranthus* sp. |
| 1558 | PPOX | 9 | *Amaranthus* sp. |
| 1559 | PPOX | 9 | *Amaranthus* sp. |
| 1560 | PPOX | 9 | *Amaranthus* sp. |
| 1561 | PPOX | 9 | *Amaranthus* sp. |
| 1562 | PPOX | 9 | *Amaranthus* sp. |
| 1563 | PPOX | 9 | *Amaranthus* sp. |
| 1564 | PPOX | 9 | *Amaranthus* sp. |
| 1565 | PPOX | 9 | *Amaranthus* sp. |
| 1566 | PPOX | 9 | *Amaranthus* sp. |
| 1567 | PPOX | 9 | *Amaranthus* sp. |
| 1568 | PPOX | 9 | *Amaranthus* sp. |
| 1569 | PPOX | 9 | *Amaranthus* sp. |
| 1570 | PPOX | 9 | *Amaranthus* sp. |
| 1571 | PPOX | 9 | *Amaranthus* sp. |
| 1572 | PPOX | 9 | *Amaranthus* sp. |
| 1573 | PPOX | 9 | *Amaranthus* sp. |
| 1574 | PPOX | 9 | *Amaranthus* sp. |
| 1575 | PPOX | 9 | *Amaranthus* sp. |
| 1576 | PPOX | 9 | *Amaranthus* sp. |
| 1577 | PPOX | 9 | *Amaranthus* sp. |
| 1578 | PPOX | 9 | *Amaranthus* sp. |
| 1579 | PPOX | 9 | *Amaranthus* sp. |
| 1580 | PPOX | 9 | *Amaranthus* sp. |
| 1581 | PPOX | 9 | *Amaranthus* sp. |
| 1582 | PPOX | 9 | *Amaranthus* sp. |
| 1583 | PPOX | 9 | *Amaranthus* sp. |
| 1584 | PPOX | 9 | *Amaranthus* sp. |
| 1585 | PPOX | 9 | *Amaranthus* sp. |
| 1586 | PPOX | 9 | *Amaranthus* sp. |
| 1587 | PPOX | 9 | *Amaranthus* sp. |
| 1588 | PPOX | 9 | *Amaranthus* sp. |
| 1589 | PPOX | 9 | *Amaranthus* sp. |
| 1590 | PPOX | 9 | *Amaranthus* sp. |
| 1591 | PPOX | 9 | *Amaranthus* sp. |
| 1592 | PPOX | 9 | *Amaranthus* sp. |
| 1593 | PPOX | 9 | *Amaranthus* sp. |
| 1594 | PPOX | 9 | *Amaranthus* sp. |
| 1595 | PPOX | 9 | *Amaranthus* sp. |
| 1596 | PPOX | 9 | *Amaranthus* sp. |
| 1597 | PPOX | 9 | *Amaranthus* sp. |
| 1598 | PPOX | 9 | *Amaranthus* sp. |
| 1599 | PPOX | 9 | *Amaranthus* sp. |
| 1600 | PPOX | 9 | *Amaranthus* sp. |
| 1601 | PPOX | 9 | *Amaranthus* sp. |
| 1602 | PPOX | 9 | *Amaranthus* sp. |
| 1603 | PPOX | 9 | *Amaranthus* sp. |
| 1604 | PPOX | 9 | *Amaranthus* sp. |
| 1605 | PPOX | 9 | *Amaranthus* sp. |
| 1606 | PPOX | 9 | *Amaranthus* sp. |
| 1607 | PPOX | 9 | *Amaranthus* sp. |
| 1608 | PPOX | 9 | *Amaranthus* sp. |
| 1609 | PPOX | 9 | *Amaranthus* sp. |
| 1610 | PPOX | 9 | *Amaranthus* sp. |
| 1611 | PPOX | 9 | *Amaranthus* sp. |
| 1612 | PPOX | 9 | *Amaranthus* sp. |
| 1613 | PPOX | 9 | *Amaranthus* sp. |
| 1614 | PPOX | 9 | *Amaranthus* sp. |
| 1615 | PPOX | 9 | *Amaranthus* sp. |
| 1616 | PPOX | 9 | *Amaranthus* sp. |
| 1617 | PPOX | 9 | *Amaranthus* sp. |
| 1618 | PPOX | 9 | *Amaranthus* sp. |
| 1619 | PPOX | 9 | *Amaranthus* sp. |
| 1620 | PPOX | 9 | *Amaranthus* sp. |
| 1621 | PPOX | 9 | *Amaranthus* sp. |
| 1622 | PPOX | 9 | *Amaranthus* sp. |
| 1623 | PPOX | 9 | *Amaranthus* sp. |
| 1624 | PPOX | 9 | *Amaranthus* sp. |
| 1625 | PPOX | 9 | *Amaranthus* sp. |
| 1626 | PPOX | 9 | *Amaranthus* sp. |
| 1627 | PPOX | 9 | *Amaranthus* sp. |
| 1628 | PPOX | 9 | *Amaranthus* sp. |
| 1629 | PPOX | 9 | *Amaranthus* sp. |
| 1630 | PPOX | 9 | *Amaranthus* sp. |
| 1631 | PPOX | 9 | *Amaranthus* sp. |
| 1632 | PPOX | 9 | *Amaranthus* sp. |
| 1633 | PPOX | 9 | *Amaranthus* sp. |
| 1634 | PPOX | 9 | *Amaranthus* sp. |
| 1635 | PPOX | 9 | *Amaranthus* sp. |
| 1636 | PPOX | 9 | *Amaranthus* sp. |
| 1637 | PPOX | 9 | *Amaranthus* sp. |
| 1638 | PPOX | 9 | *Amaranthus* sp. |
| 1639 | PPOX | 9 | *Amaranthus* sp. |
| 1640 | PPOX | 9 | *Amaranthus* sp. |
| 1641 | PPOX | 9 | *Amaranthus* sp. |
| 1642 | PPOX | 9 | *Amaranthus* sp. |
| 1643 | PPOX | 9 | *Amaranthus* sp. |
| 1644 | PPOX | 9 | *Amaranthus* sp. |
| 1645 | PPOX | 9 | *Amaranthus* sp. |
| 1646 | PPOX | 9 | *Amaranthus* sp. |
| 1647 | PPOX | 9 | *Amaranthus* sp. |
| 1648 | PPOX | 9 | *Amaranthus* sp. |
| 1649 | PPOX | 9 | *Amaranthus* sp. |
| 1650 | PPOX | 9 | *Amaranthus* sp. |
| 1651 | PPOX | 9 | *Amaranthus* sp. |
| 1652 | PPOX | 9 | *Amaranthus* sp. |
| 1653 | PPOX | 9 | *Amaranthus* sp. |
| 1654 | PPOX | 9 | *Amaranthus* sp. |
| 1655 | PPOX | 9 | *Amaranthus* sp. |
| 1656 | PPOX | 9 | *Amaranthus* sp. |
| 1657 | PPOX | 9 | *Amaranthus* sp. |
| 1658 | PPOX | 9 | *Amaranthus* sp. |
| 1659 | PPOX | 9 | *Amaranthus* sp. |
| 1660 | PPOX | 9 | *Amaranthus* sp. |

TABLE 3-continued

| SEQ ID NO | Gene | #Species | Species |
|---|---|---|---|
| 1661 | PPOX | 9 | *Amaranthus* sp. |
| 1662 | PPOX | 9 | *Amaranthus* sp. |
| 1663 | PPOX | 9 | *Amaranthus* sp. |
| 1664 | PPOX | 9 | *Amaranthus* sp. |
| 1665 | PPOX | 9 | *Amaranthus* sp. |
| 1666 | PPOX | 9 | *Amaranthus* sp. |
| 1667 | PPOX | 9 | *Amaranthus* sp. |
| 1668 | PPOX | 9 | *Amaranthus* sp. |
| 1669 | PPOX | 9 | *Amaranthus* sp. |
| 1670 | PPOX | 9 | *Amaranthus* sp. |
| 1671 | PPOX | 9 | *Amaranthus* sp. |
| 1672 | PPOX | 9 | *Amaranthus* sp. |
| 1673 | PPOX | 9 | *Amaranthus* sp. |
| 1674 | PPOX | 9 | *Amaranthus* sp. |
| 1675 | PPOX | 9 | *Amaranthus* sp. |
| 1676 | PPOX | 9 | *Amaranthus* sp. |
| 1677 | PPOX | 9 | *Amaranthus* sp. |
| 1678 | PPOX | 9 | *Amaranthus* sp. |
| 1679 | PPOX | 9 | *Amaranthus* sp. |
| 1680 | PPOX | 9 | *Amaranthus* sp. |
| 1681 | PPOX | 9 | *Amaranthus* sp. |
| 1682 | PPOX | 9 | *Amaranthus* sp. |
| 1683 | PPOX | 9 | *Amaranthus* sp. |
| 1684 | PPOX | 9 | *Amaranthus* sp. |
| 1685 | PPOX | 9 | *Amaranthus* sp. |
| 1686 | PPOX | 9 | *Amaranthus* sp. |
| 1687 | PPOX | 9 | *Amaranthus* sp. |
| 1688 | PPOX | 9 | *Amaranthus* sp. |
| 1689 | PPOX | 9 | *Amaranthus* sp. |
| 1690 | PPOX | 9 | *Amaranthus* sp. |
| 1691 | PPOX | 9 | *Amaranthus* sp. |
| 1692 | PPOX | 9 | *Amaranthus* sp. |
| 1693 | PPOX | 9 | *Amaranthus* sp. |
| 1694 | PPOX | 9 | *Amaranthus* sp. |
| 1695 | PPOX | 9 | *Amaranthus* sp. |
| 1696 | PPOX | 9 | *Amaranthus* sp. |
| 1697 | PPOX | 9 | *Amaranthus* sp. |
| 1698 | PPOX | 9 | *Amaranthus* sp. |
| 1699 | PPOX | 9 | *Amaranthus* sp. |
| 1700 | PPOX | 9 | *Amaranthus* sp. |
| 1701 | PPOX | 9 | *Amaranthus* sp. |
| 1702 | PPOX | 9 | *Amaranthus* sp. |
| 1703 | PPOX | 9 | *Amaranthus* sp. |
| 1704 | PPOX | 9 | *Amaranthus* sp. |
| 1705 | PPOX | 9 | *Amaranthus* sp. |
| 1706 | PPOX | 9 | *Amaranthus* sp. |
| 1707 | PPOX | 9 | *Amaranthus* sp. |
| 1708 | PPOX | 9 | *Amaranthus* sp. |
| 1709 | PPOX | 9 | *Amaranthus* sp. |
| 1710 | PPOX | 9 | *Amaranthus* sp. |
| 1711 | PPOX | 9 | *Amaranthus* sp. |
| 1712 | PPOX | 9 | *Amaranthus* sp. |
| 1713 | PPOX | 9 | *Amaranthus* sp. |
| 1714 | PPOX | 9 | *Amaranthus* sp. |
| 1715 | PPOX | 9 | *Amaranthus* sp. |
| 1716 | PPOX | 9 | *Amaranthus* sp. |
| 1717 | PPOX | 9 | *Amaranthus* sp. |
| 1718 | PPOX | 9 | *Amaranthus* sp. |
| 1719 | PPOX | 9 | *Amaranthus* sp. |
| 1720 | PPOX | 9 | *Amaranthus* sp. |
| 1721 | PPOX | 9 | *Amaranthus* sp. |
| 1722 | PPOX | 9 | *Amaranthus* sp. |
| 1723 | PPOX | 9 | *Amaranthus* sp. |
| 1724 | PPOX | 9 | *Amaranthus* sp. |
| 1725 | PPOX | 9 | *Amaranthus* sp. |
| 1726 | PPOX | 9 | *Amaranthus* sp. |
| 1727 | PPOX | 9 | *Amaranthus* sp. |
| 1728 | PPOX | 9 | *Amaranthus* sp. |
| 1729 | PPOX | 9 | *Amaranthus* sp. |
| 1730 | PPOX | 9 | *Amaranthus* sp. |
| 1731 | PPOX | 9 | *Amaranthus* sp. |
| 1732 | PPOX | 9 | *Amaranthus* sp. |
| 1733 | PPOX | 9 | *Amaranthus* sp. |
| 1734 | PPOX | 9 | *Amaranthus* sp. |
| 1735 | PPOX | 9 | *Amaranthus* sp. |
| 1736 | PPOX | 9 | *Amaranthus* sp. |
| 1737 | PPOX | 9 | *Amaranthus* sp. |
| 1738 | PPOX | 9 | *Amaranthus* sp. |
| 1739 | PPOX | 9 | *Amaranthus* sp. |
| 1740 | PPOX | 9 | *Amaranthus* sp. |
| 1741 | PPOX | 9 | *Amaranthus* sp. |
| 1742 | PPOX | 9 | *Amaranthus* sp. |
| 1743 | PPOX | 9 | *Amaranthus* sp. |
| 1744 | PPOX | 9 | *Amaranthus* sp. |
| 1745 | PPOX | 9 | *Amaranthus* sp. |
| 1746 | PPOX | 9 | *Amaranthus* sp. |
| 1747 | PPOX | 9 | *Amaranthus* sp. |
| 1748 | PPOX | 9 | *Amaranthus* sp. |
| 1749 | PPOX | 9 | *Amaranthus* sp. |
| 1750 | PPOX | 9 | *Amaranthus* sp. |
| 1751 | PPOX | 9 | *Amaranthus* sp. |
| 1752 | PPOX | 9 | *Amaranthus* sp. |
| 1753 | PPOX | 9 | *Amaranthus* sp. |
| 1754 | PPOX | 9 | *Amaranthus* sp. |
| 1755 | PPOX | 9 | *Amaranthus* sp. |
| 1756 | PPOX | 9 | *Amaranthus* sp. |
| 1757 | PPOX | 9 | *Amaranthus* sp. |
| 1758 | PPOX | 9 | *Amaranthus* sp. |
| 1759 | PPOX | 9 | *Amaranthus* sp. |
| 1760 | PPOX | 9 | *Amaranthus* sp. |
| 1761 | PPOX | 9 | *Amaranthus* sp. |
| 1762 | PPOX | 9 | *Amaranthus* sp. |
| 1763 | PPOX | 9 | *Amaranthus* sp. |
| 1764 | PPOX | 9 | *Amaranthus* sp. |
| 1765 | PPOX | 9 | *Amaranthus* sp. |
| 1766 | PPOX | 9 | *Amaranthus* sp. |
| 1767 | PPOX | 9 | *Amaranthus* sp. |
| 1768 | PPOX | 9 | *Amaranthus* sp. |
| 1769 | PPOX | 9 | *Amaranthus* sp. |
| 1770 | PPOX | 9 | *Amaranthus* sp. |
| 1771 | PPOX | 9 | *Amaranthus* sp. |
| 1772 | PPOX | 9 | *Amaranthus* sp. |
| 1773 | PPOX | 9 | *Amaranthus* sp. |
| 1774 | PPOX | 9 | *Amaranthus* sp. |
| 1775 | PPOX | 9 | *Amaranthus* sp. |
| 1776 | PPOX | 9 | *Amaranthus* sp. |
| 1777 | PPOX | 9 | *Amaranthus* sp. |
| 1778 | PPOX | 9 | *Amaranthus* sp. |
| 1779 | PPOX | 9 | *Amaranthus* sp. |
| 1780 | PPOX | 9 | *Amaranthus* sp. |
| 1781 | PPOX | 9 | *Amaranthus* sp. |
| 1782 | PPOX | 9 | *Amaranthus* sp. |
| 1783 | PPOX | 9 | *Amaranthus* sp. |
| 1784 | PPOX | 9 | *Amaranthus* sp. |
| 1785 | PPOX | 9 | *Amaranthus* sp. |
| 1786 | PPOX | 9 | *Amaranthus* sp. |
| 1787 | PPOX | 9 | *Amaranthus* sp. |
| 1788 | PPOX | 9 | *Amaranthus* sp. |
| 1789 | PPOX | 9 | *Amaranthus* sp. |
| 1790 | PPOX | 9 | *Amaranthus* sp. |
| 1791 | PPOX | 9 | *Amaranthus* sp. |
| 1792 | PPOX | 9 | *Amaranthus* sp. |
| 1793 | PPOX | 9 | *Amaranthus* sp. |
| 1794 | PPOX | 9 | *Amaranthus* sp. |
| 1795 | PPOX | 9 | *Amaranthus* sp. |
| 1796 | PPOX | 9 | *Amaranthus* sp. |
| 1797 | PPOX | 9 | *Amaranthus* sp. |
| 1798 | PPOX | 9 | *Amaranthus* sp. |
| 1799 | PPOX | 9 | *Amaranthus* sp. |
| 1800 | PPOX | 9 | *Amaranthus* sp. |
| 1801 | PPOX | 9 | *Amaranthus* sp. |
| 1802 | PPOX | 9 | *Amaranthus* sp. |
| 1803 | PPOX | 9 | *Amaranthus* sp. |
| 1804 | PPOX | 9 | *Amaranthus* sp. |
| 1805 | PPOX | 9 | *Amaranthus* sp. |
| 1806 | PPOX | 9 | *Amaranthus* sp. |
| 1807 | PPOX | 9 | *Amaranthus* sp. |
| 1808 | PPOX | 9 | *Amaranthus* sp. |
| 1809 | PPOX | 9 | *Amaranthus* sp. |
| 1810 | PPOX | 9 | *Amaranthus* sp. |
| 1811 | PPOX | 9 | *Amaranthus* sp. |
| 1812 | PPOX | 9 | *Amaranthus* sp. |
| 1813 | PPOX | 9 | *Amaranthus* sp. |
| 1814 | PPOX | 9 | *Amaranthus* sp. |

TABLE 3-continued

| SEQ ID NO | Gene | #Species | Species |
|---|---|---|---|
| 1815 | PPOX | 9 | *Amaranthus* sp. |
| 1816 | PPOX | 9 | *Amaranthus* sp. |
| 1817 | PPOX | 9 | *Amaranthus* sp. |
| 1818 | PPOX | 9 | *Amaranthus* sp. |
| 1819 | PPOX | 9 | *Amaranthus* sp. |
| 1820 | PPOX | 9 | *Amaranthus* sp. |
| 1821 | PPOX | 9 | *Amaranthus* sp. |
| 1822 | PPOX | 9 | *Amaranthus* sp. |
| 1823 | PPOX | 9 | *Amaranthus* sp. |
| 1824 | PPOX | 9 | *Amaranthus* sp. |
| 1825 | PPOX | 9 | *Amaranthus* sp. |
| 1826 | PPOX | 9 | *Amaranthus* sp. |
| 1827 | PPOX | 9 | *Amaranthus* sp. |
| 1828 | PPOX | 9 | *Amaranthus* sp. |
| 1829 | PPOX | 9 | *Amaranthus* sp. |
| 1830 | PPOX | 9 | *Amaranthus* sp. |
| 1831 | PPOX | 9 | *Amaranthus* sp. |
| 1832 | PPOX | 9 | *Amaranthus* sp. |
| 1833 | PPOX | 9 | *Amaranthus* sp. |
| 1834 | PPOX | 9 | *Amaranthus* sp. |
| 1835 | PPOX | 9 | *Amaranthus* sp. |
| 1836 | PPOX | 9 | *Amaranthus* sp. |
| 1837 | PPOX | 9 | *Amaranthus* sp. |
| 1838 | PPOX | 9 | *Amaranthus* sp. |
| 1839 | PPOX | 9 | *Amaranthus* sp. |
| 1840 | PPOX | 9 | *Amaranthus* sp. |
| 1841 | PPOX | 9 | *Amaranthus* sp. |
| 1842 | PPOX | 9 | *Amaranthus* sp. |
| 1843 | PPOX | 9 | *Amaranthus* sp. |
| 1844 | PPOX | 9 | *Amaranthus* sp. |
| 1845 | PPOX | 9 | *Amaranthus* sp. |
| 1846 | PPOX | 9 | *Amaranthus* sp. |
| 1847 | PPOX | 9 | *Amaranthus* sp. |
| 1848 | PPOX | 9 | *Amaranthus* sp. |
| 1849 | PPOX | 9 | *Amaranthus* sp. |
| 1850 | PPOX | 9 | *Amaranthus* sp. |
| 1851 | PPOX | 9 | *Amaranthus* sp. |
| 1852 | PPOX | 9 | *Amaranthus* sp. |
| 1853 | PPOX | 9 | *Amaranthus* sp. |
| 1854 | PPOX | 9 | *Amaranthus* sp. |
| 1855 | PPOX | 9 | *Amaranthus* sp. |
| 1856 | PPOX | 9 | *Amaranthus* sp. |
| 1857 | PPOX | 9 | *Amaranthus* sp. |
| 1858 | PPOX | 9 | *Amaranthus* sp. |
| 1859 | PPOX | 9 | *Amaranthus* sp. |
| 1860 | PPOX | 9 | *Amaranthus* sp. |
| 1861 | PPOX | 9 | *Amaranthus* sp. |
| 1862 | PPOX | 9 | *Amaranthus* sp. |
| 1863 | PPOX | 9 | *Amaranthus* sp. |
| 1864 | PPOX | 9 | *Amaranthus* sp. |
| 1865 | PPOX | 9 | *Amaranthus* sp. |
| 1866 | PPOX | 9 | *Amaranthus* sp. |
| 1867 | PPOX | 9 | *Amaranthus* sp. |
| 1868 | PPOX | 9 | *Amaranthus* sp. |
| 1869 | PPOX | 9 | *Amaranthus* sp. |
| 1870 | PPOX | 9 | *Amaranthus* sp. |
| 1871 | PPOX | 9 | *Amaranthus* sp. |
| 1872 | PPOX | 9 | *Amaranthus* sp. |
| 1873 | PPOX | 9 | *Amaranthus* sp. |
| 1874 | PPOX | 9 | *Amaranthus* sp. |
| 1875 | PPOX | 9 | *Amaranthus* sp. |
| 1876 | PPOX | 9 | *Amaranthus* sp. |
| 1877 | PPOX | 9 | *Amaranthus* sp. |
| 1878 | PPOX | 9 | *Amaranthus* sp. |
| 1879 | PPOX | 9 | *Amaranthus* sp. |
| 1880 | PPOX | 9 | *Amaranthus* sp. |
| 1881 | PPOX | 9 | *Amaranthus* sp. |
| 1882 | PPOX | 9 | *Amaranthus* sp. |
| 1883 | PPOX | 9 | *Amaranthus* sp. |
| 1884 | PPOX | 9 | *Amaranthus* sp. |
| 1885 | PPOX | 9 | *Amaranthus* sp. |
| 1886 | PPOX | 9 | *Amaranthus* sp. |
| 1887 | PPOX | 9 | *Amaranthus* sp. |
| 1888 | PPOX | 9 | *Amaranthus* sp. |
| 1889 | PPOX | 9 | *Amaranthus* sp. |
| 1890 | PPOX | 9 | *Amaranthus* sp. |
| 1891 | PPOX | 9 | *Amaranthus* sp. |
| 1892 | PPOX | 9 | *Amaranthus* sp. |
| 1893 | PPOX | 9 | *Amaranthus* sp. |
| 1894 | PPOX | 9 | *Amaranthus* sp. |
| 1895 | PPOX | 9 | *Amaranthus* sp. |
| 1896 | PPOX | 9 | *Amaranthus* sp. |
| 1897 | PPOX | 9 | *Amaranthus* sp. |
| 1898 | PPOX | 9 | *Amaranthus* sp. |
| 1899 | PPOX | 9 | *Amaranthus* sp. |
| 1900 | PPOX | 9 | *Amaranthus* sp. |
| 1901 | PPOX | 9 | *Amaranthus* sp. |
| 1902 | PPOX | 9 | *Amaranthus* sp. |
| 1903 | PPOX | 9 | *Amaranthus* sp. |
| 1904 | PPOX | 9 | *Amaranthus* sp. |
| 1905 | PPOX | 9 | *Amaranthus* sp. |
| 1906 | PPOX | 9 | *Amaranthus* sp. |
| 1907 | PPOX | 9 | *Amaranthus* sp. |
| 1908 | PPOX | 9 | *Amaranthus* sp. |
| 1909 | PPOX | 9 | *Amaranthus* sp. |
| 1910 | PPOX | 9 | *Amaranthus* sp. |
| 1911 | PPOX | 9 | *Amaranthus* sp. |
| 1912 | PPOX | 9 | *Amaranthus* sp. |
| 1913 | PPOX | 9 | *Amaranthus* sp. |
| 1914 | PPOX | 9 | *Amaranthus* sp. |
| 1915 | PPOX | 9 | *Amaranthus* sp. |
| 1916 | PPOX | 9 | *Amaranthus* sp. |
| 1917 | PPOX | 9 | *Amaranthus* sp. |
| 1918 | PPOX | 9 | *Amaranthus* sp. |
| 1919 | PPOX | 9 | *Amaranthus* sp. |
| 1920 | PPOX | 9 | *Amaranthus* sp. |
| 1921 | PPOX | 9 | *Amaranthus* sp. |
| 1922 | PPOX | 9 | *Amaranthus* sp. |
| 1923 | PPOX | 9 | *Amaranthus* sp. |
| 1924 | PPOX | 9 | *Amaranthus* sp. |
| 1925 | PPOX | 9 | *Amaranthus* sp. |
| 1926 | PPOX | 9 | *Amaranthus* sp. |
| 1927 | PPOX | 9 | *Amaranthus* sp. |
| 1928 | PPOX | 9 | *Amaranthus* sp. |
| 1929 | PPOX | 9 | *Amaranthus* sp. |
| 1930 | PPOX | 9 | *Amaranthus* sp. |
| 1931 | PPOX | 9 | *Amaranthus* sp. |
| 1932 | PPOX | 9 | *Amaranthus* sp. |
| 1933 | PPOX | 9 | *Amaranthus* sp. |
| 1934 | PPOX | 9 | *Amaranthus* sp. |
| 1935 | PPOX | 9 | *Amaranthus* sp. |
| 1936 | PPOX | 9 | *Amaranthus* sp. |
| 1937 | PPOX | 9 | *Amaranthus* sp. |
| 1938 | PPOX | 9 | *Amaranthus* sp. |
| 1939 | PPOX | 9 | *Amaranthus* sp. |
| 1940 | PPOX | 9 | *Amaranthus* sp. |
| 1941 | PPOX | 9 | *Amaranthus* sp. |
| 1942 | PPOX | 9 | *Amaranthus* sp. |
| 1943 | PPOX | 9 | *Amaranthus* sp. |
| 1944 | PPOX | 9 | *Amaranthus* sp. |
| 1945 | PPOX | 9 | *Amaranthus* sp. |
| 1946 | PPOX | 9 | *Amaranthus* sp. |
| 1947 | PPOX | 9 | *Amaranthus* sp. |
| 1948 | PPOX | 9 | *Amaranthus* sp. |
| 1949 | PPOX | 9 | *Amaranthus* sp. |
| 1950 | PPOX | 9 | *Amaranthus* sp. |
| 1951 | PPOX | 9 | *Amaranthus* sp. |
| 1952 | PPOX | 9 | *Amaranthus* sp. |
| 1953 | PPOX | 9 | *Amaranthus* sp. |
| 1954 | PPOX | 9 | *Amaranthus* sp. |
| 1955 | PPOX | 9 | *Amaranthus* sp. |
| 1956 | PPOX | 9 | *Amaranthus* sp. |
| 1957 | PPOX | 9 | *Amaranthus* sp. |
| 1958 | PPOX | 9 | *Amaranthus* sp. |
| 1959 | PPOX | 9 | *Amaranthus* sp. |
| 1960 | PPOX | 9 | *Amaranthus* sp. |
| 1961 | PPOX | 9 | *Amaranthus* sp. |
| 1962 | PPOX | 9 | *Amaranthus* sp. |
| 1963 | PPOX | 9 | *Amaranthus* sp. |
| 1964 | PPOX | 9 | *Amaranthus* sp. |
| 1965 | PPOX | 9 | *Amaranthus* sp. |
| 1966 | PPOX | 9 | *Amaranthus* sp. |
| 1967 | PPOX | 9 | *Amaranthus* sp. |
| 1968 | PPOX | 9 | *Amaranthus* sp. |

TABLE 3-continued

| SEQ ID NO | Gene | #Species | Species |
|---|---|---|---|
| 1969 | PPOX | 9 | *Amaranthus* sp. |
| 1970 | PPOX | 9 | *Amaranthus* sp. |
| 1971 | PPOX | 9 | *Amaranthus* sp. |
| 1972 | PPOX | 9 | *Amaranthus* sp. |
| 1973 | PPOX | 9 | *Amaranthus* sp. |
| 1974 | PPOX | 9 | *Amaranthus* sp. |
| 1975 | PPOX | 9 | *Amaranthus* sp. |
| 1976 | PPOX | 9 | *Amaranthus* sp. |
| 1977 | PPOX | 9 | *Amaranthus* sp. |
| 1978 | PPOX | 9 | *Amaranthus* sp. |
| 1979 | PPOX | 9 | *Amaranthus* sp. |
| 1980 | PPOX | 9 | *Amaranthus* sp. |
| 1981 | PPOX | 9 | *Amaranthus* sp. |
| 1982 | PPOX | 9 | *Amaranthus* sp. |
| 1983 | PPOX | 9 | *Amaranthus* sp. |
| 1984 | PPOX | 9 | *Amaranthus* sp. |
| 1985 | PPOX | 9 | *Amaranthus* sp. |
| 1986 | PPOX | 9 | *Amaranthus* sp. |
| 1987 | PPOX | 9 | *Amaranthus* sp. |
| 1988 | PPOX | 9 | *Amaranthus* sp. |
| 1989 | PPOX | 9 | *Amaranthus* sp. |
| 1990 | PPOX | 9 | *Amaranthus* sp. |
| 1991 | PPOX | 9 | *Amaranthus* sp. |
| 1992 | PPOX | 9 | *Amaranthus* sp. |
| 1993 | PPOX | 9 | *Amaranthus* sp. |
| 1994 | PPOX | 9 | *Amaranthus* sp. |
| 1995 | PPOX | 9 | *Amaranthus* sp. |
| 1996 | PPOX | 9 | *Amaranthus* sp. |
| 1997 | PPOX | 9 | *Amaranthus* sp. |
| 1998 | PPOX | 9 | *Amaranthus* sp. |
| 1999 | PPOX | 9 | *Amaranthus* sp. |
| 2000 | PPOX | 9 | *Amaranthus* sp. |
| 2001 | PPOX | 9 | *Amaranthus* sp. |
| 2002 | PPOX | 9 | *Amaranthus* sp. |
| 2003 | PPOX | 9 | *Amaranthus* sp. |
| 2004 | PPOX | 9 | *Amaranthus* sp. |
| 2005 | PPOX | 9 | *Amaranthus* sp. |
| 2006 | PPOX | 9 | *Amaranthus* sp. |
| 2007 | PPOX | 9 | *Amaranthus* sp. |
| 2008 | PPOX | 9 | *Amaranthus* sp. |
| 2009 | PPOX | 9 | *Amaranthus* sp. |
| 2010 | PPOX | 9 | *Amaranthus* sp. |
| 2011 | PPOX | 9 | *Amaranthus* sp. |
| 2012 | PPOX | 9 | *Amaranthus* sp. |
| 2013 | PPOX | 9 | *Amaranthus* sp. |
| 2014 | PPOX | 9 | *Amaranthus* sp. |
| 2015 | PPOX | 9 | *Amaranthus* sp. |
| 2016 | PPOX | 9 | *Amaranthus* sp. |
| 2017 | PPOX | 9 | *Amaranthus* sp. |
| 2018 | PPOX | 9 | *Amaranthus* sp. |
| 2019 | PPOX | 9 | *Amaranthus* sp. |
| 2020 | PPOX | 9 | *Amaranthus* sp. |
| 2021 | PPOX | 9 | *Amaranthus* sp. |
| 2022 | PPOX | 9 | *Amaranthus* sp. |
| 2023 | PPOX | 9 | *Amaranthus* sp. |
| 2024 | PPOX | 9 | *Amaranthus* sp. |
| 2025 | PPOX | 9 | *Amaranthus* sp. |
| 2026 | PPOX | 9 | *Amaranthus* sp. |
| 2027 | PPOX | 9 | *Amaranthus* sp. |
| 2028 | PPOX | 9 | *Amaranthus* sp. |
| 2029 | PPOX | 9 | *Amaranthus* sp. |
| 2030 | PPOX | 9 | *Amaranthus* sp. |
| 2031 | PPOX | 9 | *Amaranthus* sp. |
| 2032 | PPOX | 9 | *Amaranthus* sp. |
| 2033 | PPOX | 9 | *Amaranthus* sp. |
| 2034 | PPOX | 9 | *Amaranthus* sp. |
| 2035 | PPOX | 9 | *Amaranthus* sp. |
| 2036 | PPOX | 9 | *Amaranthus* sp. |
| 2037 | PPOX | 9 | *Amaranthus* sp. |
| 2038 | PPOX | 9 | *Amaranthus* sp. |
| 2039 | PPOX | 9 | *Amaranthus* sp. |
| 2040 | PPOX | 9 | *Amaranthus* sp. |
| 2041 | PPOX | 9 | *Amaranthus* sp. |
| 2042 | PPOX | 9 | *Amaranthus* sp. |
| 2043 | PPOX | 9 | *Amaranthus* sp. |
| 2044 | PPOX | 9 | *Amaranthus* sp. |
| 2045 | PPOX | 9 | *Amaranthus* sp. |
| 2046 | PPOX | 9 | *Amaranthus* sp. |
| 2047 | PPOX | 9 | *Amaranthus* sp. |
| 2048 | PPOX | 9 | *Amaranthus* sp. |
| 2049 | PPOX | 9 | *Amaranthus* sp. |
| 2050 | PPOX | 9 | *Amaranthus* sp. |
| 2051 | PPOX | 9 | *Amaranthus* sp. |
| 2052 | PPOX | 9 | *Amaranthus* sp. |
| 2053 | PPOX | 9 | *Amaranthus* sp. |
| 2054 | PPOX | 9 | *Amaranthus* sp. |
| 2055 | PPOX | 9 | *Amaranthus* sp. |
| 2056 | PPOX | 9 | *Amaranthus* sp. |
| 2057 | PPOX | 9 | *Amaranthus* sp. |
| 2058 | PPOX | 9 | *Amaranthus* sp. |
| 2059 | PPOX | 9 | *Amaranthus* sp. |
| 2060 | PPOX | 9 | *Amaranthus* sp. |
| 2061 | PPOX | 9 | *Amaranthus* sp. |
| 2062 | PPOX | 9 | *Amaranthus* sp. |
| 2063 | PPOX | 9 | *Amaranthus* sp. |
| 2064 | PPOX | 9 | *Amaranthus* sp. |
| 2065 | PPOX | 9 | *Amaranthus* sp. |
| 2066 | PPOX | 9 | *Amaranthus* sp. |
| 2067 | PPOX | 9 | *Amaranthus* sp. |
| 2068 | PPOX | 9 | *Amaranthus* sp. |
| 2069 | PPOX | 9 | *Amaranthus* sp. |
| 2070 | PPOX | 9 | *Amaranthus* sp. |
| 2071 | PPOX | 9 | *Amaranthus* sp. |
| 2072 | PPOX | 9 | *Amaranthus* sp. |
| 2073 | PPOX | 9 | *Amaranthus* sp. |
| 2074 | PPOX | 9 | *Amaranthus* sp. |
| 2075 | PPOX | 9 | *Amaranthus* sp. |
| 2076 | PPOX | 9 | *Amaranthus* sp. |
| 2077 | PPOX | 9 | *Amaranthus* sp. |
| 2078 | PPOX | 9 | *Amaranthus* sp. |
| 2079 | PPOX | 9 | *Amaranthus* sp. |
| 2080 | PPOX | 9 | *Amaranthus* sp. |
| 2081 | PPOX | 9 | *Amaranthus* sp. |
| 2082 | PPOX | 9 | *Amaranthus* sp. |
| 2083 | PPOX | 9 | *Amaranthus* sp. |
| 2084 | PPOX | 9 | *Amaranthus* sp. |
| 2085 | PPOX | 9 | *Amaranthus* sp. |
| 2086 | PPOX | 9 | *Amaranthus* sp. |
| 2087 | PPOX | 9 | *Amaranthus* sp. |
| 2088 | PPOX | 9 | *Amaranthus* sp. |
| 2089 | PPOX | 9 | *Amaranthus* sp. |
| 2090 | PPOX | 9 | *Amaranthus* sp. |
| 2091 | PPOX | 9 | *Amaranthus* sp. |
| 2092 | PPOX | 9 | *Amaranthus* sp. |
| 2093 | PPOX | 9 | *Amaranthus* sp. |
| 2094 | PPOX | 9 | *Amaranthus* sp. |
| 2095 | PPOX | 9 | *Amaranthus* sp. |
| 2096 | PPOX | 9 | *Amaranthus* sp. |
| 2097 | PPOX | 9 | *Amaranthus* sp. |
| 2098 | PPOX | 9 | *Amaranthus* sp. |
| 2099 | PPOX | 9 | *Amaranthus* sp. |
| 2100 | PPOX | 9 | *Amaranthus* sp. |
| 2101 | PPOX | 9 | *Amaranthus* sp. |
| 2102 | PPOX | 9 | *Amaranthus* sp. |
| 2103 | PPOX | 9 | *Amaranthus* sp. |
| 2104 | PPOX | 9 | *Amaranthus* sp. |
| 2105 | PPOX | 9 | *Amaranthus* sp. |
| 2106 | PPOX | 9 | *Amaranthus* sp. |
| 2107 | PPOX | 9 | *Amaranthus* sp. |
| 2108 | PPOX | 9 | *Amaranthus* sp. |
| 2109 | PPOX | 9 | *Amaranthus* sp. |
| 2110 | PPOX | 9 | *Amaranthus* sp. |
| 2111 | PPOX | 9 | *Amaranthus* sp. |
| 2112 | PPOX | 9 | *Amaranthus* sp. |
| 2113 | PPOX | 9 | *Amaranthus* sp. |
| 2114 | PPOX | 9 | *Amaranthus* sp. |
| 2115 | PPOX | 9 | *Amaranthus* sp. |
| 2116 | PPOX | 9 | *Amaranthus* sp. |
| 2117 | PPOX | 9 | *Amaranthus* sp. |
| 2118 | PPOX | 9 | *Amaranthus* sp. |
| 2119 | PPOX | 9 | *Amaranthus* sp. |
| 2120 | PPOX | 9 | *Amaranthus* sp. |
| 2121 | PPOX | 9 | *Amaranthus* sp. |
| 2122 | PPOX | 9 | *Amaranthus* sp. |

TABLE 3-continued

| SEQ ID NO | Gene | #Species | Species |
|---|---|---|---|
| 2123 | PPOX | 9 | *Amaranthus* sp. |
| 2124 | PPOX | 9 | *Amaranthus* sp. |
| 2125 | PPOX | 9 | *Amaranthus* sp. |
| 2126 | PPOX | 9 | *Amaranthus* sp. |
| 2127 | PPOX | 9 | *Amaranthus* sp. |
| 2128 | PPOX | 9 | *Amaranthus* sp. |
| 2129 | PPOX | 9 | *Amaranthus* sp. |
| 2130 | PPOX | 9 | *Amaranthus* sp. |
| 2131 | PPOX | 9 | *Amaranthus* sp. |
| 2132 | PPOX | 9 | *Amaranthus* sp. |
| 2133 | PPOX | 9 | *Amaranthus* sp. |
| 2134 | PPOX | 9 | *Amaranthus* sp. |
| 2135 | PPOX | 9 | *Amaranthus* sp. |
| 2136 | PPOX | 9 | *Amaranthus* sp. |
| 2137 | PPOX | 9 | *Amaranthus* sp. |
| 2138 | PPOX | 9 | *Amaranthus* sp. |
| 2139 | PPOX | 9 | *Amaranthus* sp. |
| 2140 | PPOX | 9 | *Amaranthus* sp. |
| 2141 | PPOX | 9 | *Amaranthus* sp. |
| 2142 | PPOX | 9 | *Amaranthus* sp. |
| 2143 | PPOX | 9 | *Amaranthus* sp. |
| 2144 | PPOX | 9 | *Amaranthus* sp. |
| 2145 | PPOX | 9 | *Amaranthus* sp. |
| 2146 | PPOX | 9 | *Amaranthus* sp. |
| 2147 | PPOX | 9 | *Amaranthus* sp. |
| 2148 | PPOX | 9 | *Amaranthus* sp. |
| 2149 | PPOX | 9 | *Amaranthus* sp. |
| 2150 | PPOX | 9 | *Amaranthus* sp. |
| 2151 | PPOX | 9 | *Amaranthus* sp. |
| 2152 | PPOX | 9 | *Amaranthus* sp. |
| 2153 | PPOX | 9 | *Amaranthus* sp. |
| 2154 | PPOX | 9 | *Amaranthus* sp. |
| 2155 | PPOX | 9 | *Amaranthus* sp. |
| 2156 | PPOX | 9 | *Amaranthus* sp. |
| 2157 | PPOX | 9 | *Amaranthus* sp. |
| 2158 | PPOX | 9 | *Amaranthus* sp. |
| 2159 | PPOX | 9 | *Amaranthus* sp. |
| 2160 | PPOX | 9 | *Amaranthus* sp. |
| 2161 | PPOX | 9 | *Amaranthus* sp. |
| 2162 | PPOX | 9 | *Amaranthus* sp. |
| 2163 | PPOX | 9 | *Amaranthus* sp. |
| 2164 | PPOX | 9 | *Amaranthus* sp. |
| 2165 | PPOX | 9 | *Amaranthus* sp. |
| 2166 | PPOX | 9 | *Amaranthus* sp. |
| 2167 | PPOX | 9 | *Amaranthus* sp. |
| 2168 | PPOX | 9 | *Amaranthus* sp. |
| 2169 | PPOX | 9 | *Amaranthus* sp. |
| 2170 | PPOX | 9 | *Amaranthus* sp. |
| 2171 | PPOX | 9 | *Amaranthus* sp. |
| 2172 | PPOX | 9 | *Amaranthus* sp. |
| 2173 | PPOX | 9 | *Amaranthus* sp. |
| 2174 | PPOX | 9 | *Amaranthus* sp. |
| 2175 | PPOX | 9 | *Amaranthus* sp. |
| 2176 | PPOX | 9 | *Amaranthus* sp. |
| 2177 | PPOX | 9 | *Amaranthus* sp. |
| 2178 | PPOX | 9 | *Amaranthus* sp. |
| 2179 | PPOX | 9 | *Amaranthus* sp. |
| 2180 | PPOX | 9 | *Amaranthus* sp. |
| 2181 | PPOX | 9 | *Amaranthus* sp. |
| 2182 | PPOX | 9 | *Amaranthus* sp. |
| 2183 | PPOX | 9 | *Amaranthus* sp. |
| 2184 | PPOX | 9 | *Amaranthus* sp. |
| 2185 | PPOX | 9 | *Amaranthus* sp. |
| 2186 | PPOX | 9 | *Amaranthus* sp. |
| 2187 | PPOX | 9 | *Amaranthus* sp. |
| 2188 | PPOX | 9 | *Amaranthus* sp. |
| 2189 | PPOX | 9 | *Amaranthus* sp. |
| 2190 | PPOX | 9 | *Amaranthus* sp. |
| 2191 | PPOX | 9 | *Amaranthus* sp. |
| 2192 | PPOX | 9 | *Amaranthus* sp. |
| 2193 | PPOX | 9 | *Amaranthus* sp. |
| 2194 | PPOX | 9 | *Amaranthus* sp. |
| 2195 | PPOX | 9 | *Amaranthus* sp. |
| 2196 | PPOX | 9 | *Amaranthus* sp. |
| 2197 | PPOX | 9 | *Amaranthus* sp. |
| 2198 | PPOX | 9 | *Amaranthus* sp. |
| 2199 | PPOX | 9 | *Amaranthus* sp. |
| 2200 | PPOX | 9 | *Amaranthus* sp. |
| 2201 | PPOX | 9 | *Amaranthus* sp. |
| 2202 | PPOX | 9 | *Amaranthus* sp. |
| 2203 | PPOX | 9 | *Amaranthus* sp. |
| 2204 | PPOX | 9 | *Amaranthus* sp. |
| 2205 | PPOX | 9 | *Amaranthus* sp. |
| 2206 | PPOX | 9 | *Amaranthus* sp. |
| 2207 | PPOX | 9 | *Amaranthus* sp. |
| 2208 | PPOX | 9 | *Amaranthus* sp. |
| 2209 | PPOX | 9 | *Amaranthus* sp. |
| 2210 | PPOX | 9 | *Amaranthus* sp. |
| 2211 | PPOX | 9 | *Amaranthus* sp. |
| 2212 | PPOX | 9 | *Amaranthus* sp. |
| 2213 | PPOX | 9 | *Amaranthus* sp. |

Figure 2:
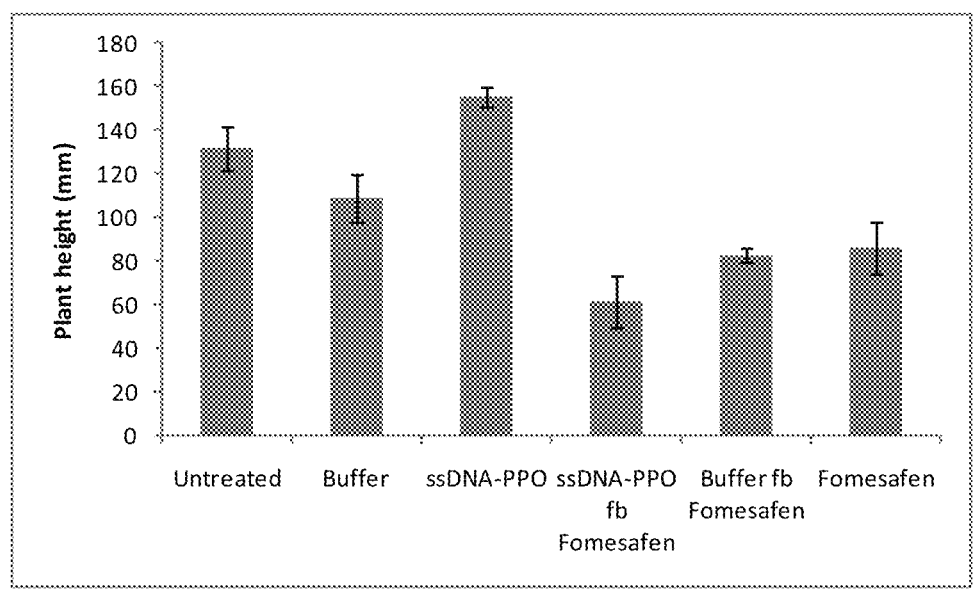
FIG. 2. Treatment of *Amaranthus palmeri* with ssDNA trigger polynucleotides and PPG oxidase inhibitor herbicide, fomesafen.
Figure 3:
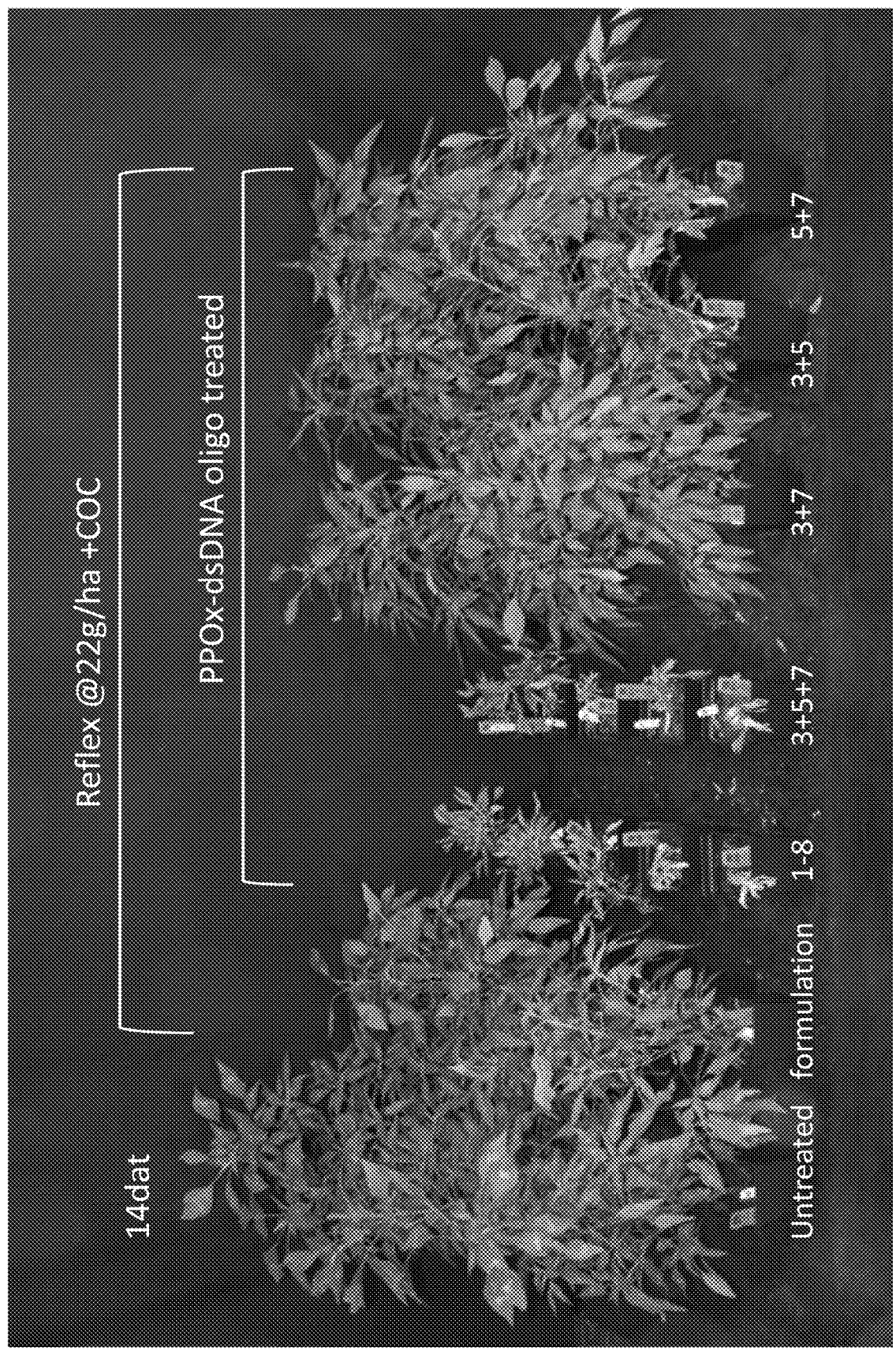
FIG. 3. Treatment of *Amaranthus palmeri* with pooled oligos and ssDNA trigger polynucleotides and PPG oxidase inhibitor herbicide, Reflex® (fomesafen).

Example 3. Methods Used Related to Treating Plants or Plant Parts with a Topical Mixture of the Trigger Molecules Glyphosate-sensitive Palmer amaranth (*A. palmeri* R-22) plants were grown in the greenhouse (30/20 C day/night T; 14 hour photoperiod) in 4 inch square pots containing Sun Gro® Redi-Earth and 3.5 kg/cubic meter Osmocote® 14-14-14 fertilizer. Palmer amaranth plants at 5 to 10 cm in height were pre-treated with a mixture of short (24-25 mer) single-strand antisense oligo DNA polynucleotides (ssDNA) targeting PPG oxidase coding or noncoding regions at 16 nmol, formulated in 10 millimolar sodium phosphate buffer (pH 6.8) containing 2% ammonium sulfate and 0.5% Silwet L-77. Plants were treated manually by pipetting 10 µL of polynucleotide solution on four fully expanded mature leaves, for a total of 40 microliters of solution per plant. Twenty-four and forty-eight hours later, the plants were treated with fomesafen (Reflex) at 22 g ai/ha and flumioxazin (Valor) at 4 g ai/ha, crop oil concentrate (COC) at 1% is added to the herbicide treatments. The formulation control is the buffer and adjuvants without the DNA polynucleotides. Four replications of each treatment were conducted. Plant height is determined just before ssDNA treatment and at intervals up to fourteen days (dat) after herbicide treatments to determine effect of the oligonucleotide and herbicide treatments. The results shown in FIG. 1 and FIG. 2 demonstrate that the oligonucleotide treatment enhanced the herbicidal activity of both fomesafen and flumioxazin.

A pool comprising eight antisense ssDNA oligonucleotides shown in Table 4 was used in the protocol as described to treat palmer amaranth plants and the individual oligonucleotides and various combinations of oligonucleotides were tested for efficacy. Surprisingly, it was necessary to have a 3 oligonucleotide pool (oligo3, 5, and 7) of the 8 oligonucleotide pool and combinations of only 2 of the 3 oligonucleotides was not effective to provide enhanced herbicide sensitivity. This result is illustrated in FIG. 3 for activity on Palmer amaranth. The same 3 oligonucleotides were also active on a related species, waterhemp (*Amaranthus rudis*).

TABLE 4

Antisense ssDNA PPG oxidase oligonucleotides

| OLIGO1 | SEQ ID NO: 2214 | GTGATATTACCTCCAACACGAT |
| OLIGO2 | SEQ ID NO: 2215 | ATAGTAAGCACAGGATCGGAG |
| OLIGO3 | SEQ ID NO: 2216 | CTTTCAATCCACTGTCAACCG |
| OLIGO4 | SEQ ID NO: 2217 | ATCAAGCGTTCGAAGACCTCAT |
| OLIGO5 | SEQ ID NO: 2218 | CAGCAATGGCGGTAGGTAACA |
| OLIGO6 | SEQ ID NO: 2219 | GCAATTGCCCGAATCCTTTTA |
| OLIGO7 | SEQ ID NO: 2220 | TAGCTCAAtATCAAGGTCCTA |
| OLIGO8 | SEQ ID NO: 2221 | TCATAAGCACCCTCTATACAC |

Example 4. A Method to Control Weeds in a Field

A method to control weeds in a field comprises the use of trigger polynucleotides that can modulate the expression of a PPG oxidase gene in one or more target weed plant species. In Table 3 (SEQ ID NOs: 1381-2221), an analysis of PPG oxidase gene sequences from seventeen plant species provided a collection of 21-mer polynucleotides that can be used in compositions to affect the growth or develop or sensitivity to PPG oxidase inhibitor herbicide to control multiple weed species in a field. A composition containing 1 or 2 or 3 or 4 or more of the polynucleotides of Table 3 would enable broad activity of the composition against the multiple weed species that occur in a field environment.

The method includes creating a composition that comprises components that include at least one polynucleotide of Table 3 or any other effective gene expression modulating polynucleotide essentially identical or essentially complementary to SEQ ID NO:1-71 or fragment thereof, a transfer agent that mobilizes the polynucleotide into a plant cell and a PPG oxidase inhibiting herbicide and optionally a polynucleotide that modulates the expression of an essential gene and optionally a herbicide that has a different mode of action relative to a PPG oxidase inhibitor. The polynucleotide of the composition includes a dsRNA, ssDNA or dsDNA or a combination thereof. A composition containing a polynucleotide can have a use rate of about 1 to 30 grams or more per acre depending on the size of the polynucleotide and the number of polynucleotides in the composition. The composition may include one or more additional herbicides as needed to provide effective multi-species weed control. A field of crop plants in need of weed plant control is treated by spray application of the composition. The composition can be provided as a tank mix, a sequential treatment of components (generally the polynucleotide followed by the herbicide), a simultaneous treatment or mixing of one or more of the components of the composition from separate containers. Treatment of the field can occur as often as needed to provide weed control and the components of the composition can be adjusted to target specific weed species or weed families.

Example 5. Herbicidal Compositions Comprising Pesticidal Agents

A method of controlling weeds and plant pest and pathogens in a field of PPG oxidase inhibitor tolerant crop plants is provided, wherein the method comprises applying a composition comprising a PPG oxidase trigger oligonucleotide, a PPG oxidase inhibitor composition and an admixture of a pest control agent. For example, the admixture comprises insecticides, fungicides, nematocides, bactericides, acaricides, growth regulators, chemosterilants, semiochemicals, repellents, attractants, pheromones, feeding stimulants or other biologically active compounds or biological agents, such as, microorganisms.

For example, the admixture comprises a fungicide compound for use on a PPG oxidase inhibitor tolerant crop plant to prevent or control plant disease caused by a plant fungal pathogen. The fungicide compound of the admixture may be a systemic or contact fungicide or mixtures of each. More particularly, the fungicide compound includes, but is not limited to, members of the chemical groups strobilurins, triazoles, chloronitriles, carboxamides and mixtures thereof. The composition may additionally have an admixture comprising an insecticidal compound or agent.

The PPG oxidase trigger oligonucleotides and PPG oxidase inhibitor (for example, fomesafen) tank mixes with fungicides, insecticides or both are tested for use in soybean and corn for control of foliar diseases and pests. Testing is conducted to develop a method for use of mixtures of the trigger oligonucleotides and fomesafen formulation and various commercially available fungicides for weed control and pest control. The field plots are planted with soybeans or corn. All plots receive a post plant application of the PPG oxidase trigger+fomesafen about 3 weeks after planting. The mixtures of trigger+fomesafen or trigger+fomesafen+fungicide+insecticides are used to treat the plots at the R1 stage of soybean development (first flowering) or tassel stage of corn. Data is taken for percent weed control at 7 and 21 days after R1 treatment, soybean safety (% necrosis, chlorosis, growth rate): 5 days after treatment, disease rating, pest ratings and yield (bushels/Acre). These mixtures and treatments are designed to provide simultaneous weed and pest control, such as fungal pest control, for example, leaf rust disease; and insect pest control, for example, aphids, armyworms, loopers, beetles, stinkbugs, and leaf hoppers.

Agricultural chemicals are provided in containers suitable for safe storage, transportation and distribution, stability of the chemical compositions, mixing with solvents and instructions for use. A container of a mixture of a trigger oligonucleotide+a herbicice+fungicide compound, or a mixture of a trigger oligonucleotide+herbicide compound and an insecticide compound, or a trigger oligonucleotide+a herbicide compound and a fungicide compound and an insecticide compound (for example, lambda-cyhalothrin, Warrier®). The container may further provide instructions on the effective use of the mixture. Containers of the present invention can be of any material that is suitable for the storage of the chemical mixture. Containers of the present invention can be of any material that is suitable for the shipment of the chemical mixture. The material can be of cardboard, plastic, metal, or a composite of these materials. The container can have a volume of 0.5 liter, 1 liter, 2 liter, 3-5 liter, 5-10 liter, 10-20 liter, 20-50 liter or more depending upon the need. A tank mix of a trigger oligonucleotide+ herbicide compound and a fungicide compound is provided, methods of application to the crop to achieve an effective dose of each compound are known to those skilled in the art and can be refined and further developed depending on the crop, weather conditions, and application equipment used.

Insecticides, fungicides, nematocides, bactericides, acaricides, growth regulators, chemosterilants, semiochemicals, repellents, attractants, pheromones, feeding stimulants or other biologically active compounds can be added to the trigger oligonucleotide to form a multi-component pesticide giving an even broader spectrum of agricultural protection. Examples of such agricultural protectants with which compounds of this invention can be formulated are: insecticides such as abamectin, acephate, azinphos-methyl, bifenthrin, buprofezin, carbofuran, chlorfenapyr, chlorpyrifos, chlorpyrifos-methyl, cyfluthrin, beta-cyfluthrin, cyhalothrin, lambda-cyhalothrin, deltamethrin, diafenthiuron, diazinon, diflubenzuron, dimethoate, esfenvalerate, fenoxycarb, fenpropathrin, fenvalerate, fipronil, flucythrinate, tau-fluvalinate, fonophos, imidacloprid, isofenphos, malathion, metaldehyde, methamidophos, methidathion, methomyl, methoprene, methoxychlor, methyl 7-chloro-2,5-dihydro-2-[[N-(methoxycarbonyl)-N-[4-(trifluoromethoxy)phenyl]amino]carbonyl]indeno[1,2-e][1,3,4]oxadiazine-4a(3H)-carboxylate (DPX-JW062), monocrotophos, oxamyl, parathion, parathion-methyl, permethrin, phorate, phosalone, phosmet, phosphamidon, pirimicarb, profenofos, rotenone, sulprofos, tebufenozide, tefluthrin, terbufos, tetrachlorvinphos, thiodicarb, tralomethrin, trichlorfon and triflumuron; most preferably a PPG oxidase inhibitor compound is formulated with a fungicide compound or combinations of fungicides, such as azoxystrobin, benomyl, blasticidin-S, Bordeaux mixture (tribasic copper sulfate), bromuconazole, captafol, captan, carbendazim, chloroneb, chlorothalonil, copper oxychloride, copper salts, cymoxanil, cyproconazole, cyprodinil (CGA 219417), diclomezine, dicloran, difenoconazole, dimethomorph, diniconazole, diniconazole-M, dodine, edifenphos, epoxiconazole (BAS 480F), famoxadone, fenarimol, fenbuconazole, fenpiclonil, fenpropidin, fenpropimorph, fluazinam, fluquinconazole, flusilazole, flutolanil, flutriafol, folpet, fosetyl-aluminum, furalaxyl, hexaconazole, ipconazole, iprobenfos, iprodione, isoprothiolane, kasugamycin, kresoxim-methyl, mancozeb, maneb, mepronil, metalaxyl, metconazole, S-methyl 7-benzothiazolecarbothioate (CGA 245704), myclobutanil, neoasozin (ferric methanearsonate), oxadixyl, penconazole, pencycuron, probenazole, prochloraz, propiconazole, pyrifenox, pyroquilon, quinoxyfen, spiroxamine (KWG4168), sulfur, tebuconazole, tetraconazole, thiabendazole, thiophanate-methyl, thiram, triadimefon, triadimenol, tricyclazole, trifloxystrobin, triticonazole, validamycin and vinclozolin; combinations of fungicides are common for example, cyproconazole and azoxystrobin, difenoconazole, and metalaxyl-M, fludioxonil and metalaxyl-M, mancozeb and metalaxyl-M, copper hydroxide and metalaxyl-M, cyprodinil and fludioxonil, cyproconazole and propiconazole; commercially available fungicide formulations for control of Asian soybean rust disease include, but are not limited to Quadris® (Syngenta Corp), Bravo® (Syngenta Corp), Echo 720® (Sipcam Agro Inc), Headline® 2.09EC (BASF Corp), Tilt® 3.6EC (Syngenta Corp), PropiMax™ 3.6EC (Dow AgroSciences), Bumper® 41.8EC (MakhteshimAgan), Folicur® 3.6F (Bayer CropScience), Laredo® 25EC (Dow AgroSciences), Laredo™ 25EW (Dow AgroSciences), Stratego® 2.08F (Bayer Corp), Domark™ 125SL (Sipcam Agro USA), and Pristine® 38% WDG (BASF Corp) these can be combined with PPG oxidase inhibitor compositions as described in the present invention to provide enhanced protection from fungal disease; nematocides such as aldoxycarb and fenamiphos; bactericides such as streptomycin; acaricides such as amitraz, chinomethionat, chlorobenzilate, cyhexatin, dicofol, dienochlor, etoxazole, fenazaquin, fenbutatin oxide, fenpropathrin, fenpyroximate, hexythiazox, propargite, pyridaben and tebufenpyrad; and biological agents such as *Bacillus thuringiensis, Bacillus thuringiensis* delta endotoxin, baculovirus, and entomopathogenic bacteria, virus and fungi.

SEQUENCE LISTING (2221 sequences)

SEQ ID NO: 1 - DNA, 1200 bp, Amaranthus albus
ggaatccttgatttgaagataggataaccagagagagtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagctcaactgccaattaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgttccttccaaacctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgattgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgttaggaccaaagcggttgtcatgactgtcccttcatacattgcaagtagcctgcttcgtccgctctcagatgttgctgcagattctcttctaaatttactatcctccagtcgcagcagtgtccctt

SEQ ID NO: 2 - DNA, 487 bp, Amaranthus albus
taggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctgctttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcagtagggctccagcatcctggttaagtaactttttgtagctgttgtaattcagatataaaatagcccacagtcaaacaagtttggaaagatgtaaaagcatgagatacagtcggtgttcattgagag

SEQ ID NO: 3 - DNA, 1847 bp, Amaranthus graecizans
gtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagctcaactgccaattaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgttccttccaagcctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgattgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgttaggaccaaagcggttgtcatgactgtcccttcatacattgcaagtagcctgcttcgtccgctctcagatgttgctgcagattctctttctaaattttactatcctccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctgctttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcagtagggctccagcatcctggttaagtaactttttgtagctgttgtaattcagatataaaatagcccacagtcaaacaagtttggaaagatgtaaaagcatgagatacagtcggtgttcattgagaggatagatgcaaataacttggacggaaaagtactagttccccattgttt

SEQ ID NO: 4 - DNA, 1170 bp, Amaranthus hybridus
gaagctaaacatcgtgttggaggtaatatcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttcccttggttcgagcaccacccggtaggaccttgatcttgagctacattggaggtgctacaaatgttggaatattacaaaagagtgaagatgaacttgcggatacagttgataaggatctcagaaaaattctgataaatccaaatgcgaaaggcagccgtgttctgggagtgagagtatggccaaaggcaatccccc

SEQ ID NO: 5 - DNA, 2344 bp, Amaranthus lividus
tagattgttgagagggaatgggcaattaagtggaatcccatttccttaaactcagctggtgtatgtaatggtgtctttccaccttcaatcatgtttgcaattctcaaacctttaacatctctaacaacctcttttagctcttctatgttggctggtgcctcaacaaatgtggcatcagcccctgcctctctgtaaagattagcacgtctaatagcttcttgaagaccgtgaggtgcacgagcatcagtccttgcaaccaagaagaaatcagattcaccaatggcttcccttgctgcagcgatcttaagggcgtgctcctctgcaggaacaactgccttaccacgcatgtgaccacacttctttggccatacttgatcctcaaggaaaacacccttggcaccagctgcgatcaagtctttgatgaacctttgaacattaagaggaccaccaccaccggtgtctccgtcaacaataacacacaaactaggagcagctgccgtaattctgcgaacaacatctaccacttctgcagttgtaagcaagccaaagtcgggcaagccaagaagagcagcggaaacaccaaaaccggagacaaagcaagctttgaagccggttttagcgcaaatggcggcggagaaagcgtcttggattccgggcattaaaattggtccctcctcggcgatcagacggtgcattgtggtctttccgactgcctcaagagaacccatttttgtttctaataatacaatttaggaattaaggaaggaggtgatgatgagttgatagaactacttagtgtgtaattgttggagctggtatcagtggactttgcattgcgcaggctctttctaccaaacacattcaatccaatctcaatttcattgtcactgaagctaaacatcgtgttggaggtaatattactaccatggagtccgatggctatatctgggaagagggtcctaatagtttccaaccctctgatcctgtgcttactatggcggttgacagtggattgaaagacgatttggttttgggagatcctgatgcccctcgtttcgtgctctggaatggtaaattaaggcctgttccttctaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttaatcgaacccttttgttctggtgtgtatgctggtgatcctacaaagttgagtatgaaagctgcatttggaaaggtctggaccttagagcaaaagggtggtagtatcatcgccggtacactcaaatctattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcatgactgtaccttcatacattgcaagtagcctgcttcgtccactctcagatgttgctgcagattctctttctaagttttactatccaccagtcgcagcagtgtccctttcttatcccaaggaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcaatagggctccaccttcctggttaactaactttttgtagctgttgtaatttgtatcatgtaatattattcagatgtaaaagcatgagatacagtcggtat

SEQ ID NO: 6 - DNA, 1866 bp, Amaranthus palmeri
aatccttgatttgaagataggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctcaactgccaattaccagaacacgattacgacccaaggagaaggagataaagtattggattgtgtaattgttggagctggtatcagtggactttgcattgctcaggctctttctaccaaacacattcaatccaatctcaatttcattgtcactgaagctaaaaatcgtgttggaggtaatatcactaccatggagtccgatggctatatctgggaagagggtcctaatagtttccaaccctccgatcctgtgcttactatggcggttgacagtggattgaaagatgatttggtcttgggagatcctaatgctcctcgttttgtgctctggaatggtaaattaaggcctgttccttccaaacctacggaccttcccttttttgatctcatgagctttcctggtaagattagggctggtcttggtgcacttggtcttcgtccttctcctcctcctccttcttatgaggaatctgttgaagaatttgtgcgccgtaatctcggcgatgaggtcttcgaacgcttgatcgaacccttttgttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcatgatgttgctgcagattctctttctaaattttactatccaccagtcgcagcagtgtccctttcttatcccaaagaagcaattagaccagaatgcttgatcgatggagaactaaaaggattcgggcaattgcatcccgcagccagggtgtggaaaccttgggaacaatttatagttcatctcttttccctggtcgagcaccacctggtaggaccttgatcttgagctacattggaggtgctacaaatgttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagtaggtcattttgatctgctagatgctgcaaaagcgggtttggcaaatgctggactaaaggggttgtttcttggtggtaattatgtatcaggtgttgccttggggaggtgtatagagggtgcttatgactctgcatctcaggttgtggatttcctctcacagtacaaagacaagtagtcatcctgattaactaactttttgtagctgttgtaatttgtatcatgtaatattattatttattcagatgtaaaagcatgatatacagtcggtgttctttgagaggatagatgcaaataacttggacggtaaagtactagttcctgtctcttatacacatct

SEQ ID NO: 7 - DNA, 1066 bp, Amaranthus palmeri
catgtggtggagatcctcaatcgctatctatgcaccatacatttcccgacgtatggaatgttgaaaaaaggtttggctctgtgtttgctggactaattcaatcaacattgttatctaagaaggaaaagggtggagggaaaatgcttctatcaagaagcctcgtgtacgcggttcattttcattccatggtggaatgcagacacttgttgacacaatgtgcaaacagcttggtgaagatgaactcaagctccagtgtgaggtgctgtccttgtcatacaaccagaaggggatcccttcattagggaattggtcagtctcttctatgtcaaataataccagtgaagatcaatcttatgatgctgtggttgtcactgctccaattcgcaatgtcaaagaaatgaagattatgaaatttggaaatccattttcacttgactttattccagaggtgacttacgtacccctttccgttatgattactgcattcaagaaggataaagtgaagagacctctcgagggcttcggagttcttatcccgtctaaagagcaacataatggactgaagactcttggtactttattttcgtctatgatgtttcctgatcgtgctccatctgatatgtgtctttttaccacatttgtcggaggaagcagaaatagaaaacttgcaaacgcttcaacggatgaattgaagcaaatagtttcttctgaccttcagcagctgttgggcactgaggacgaaccttcatttgtcaatcatctcttttggagcaatgcattcccgttgtatgggcacaattacgattctgttttgacagcaatagacaagatggaaaaggatcttcctggattttttatgcaggtaaccataagggtggactttcagtaggaaaagcgatggcctccggatgcaaggctgcggaacttgtaatatcctatctggactctcatttatatgtgaagatggatgagaagaccgcgtaatctttctgaaattccttcactgtaaccaagcgtgtgaagcccctgattttgcgtctgtatatccgatgatatatcgctggat

SEQ ID NO: 8 - DNA, 294 bp, Amaranthus palmeri
ggggagcgggttgctggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctcaactgccaattaccagaacacgattacgacccaaggagaaggagataaagtattggattgtgtaattgttggagctggtatcagtggactttgcattg

SEQ ID NO: 9 - DNA, 6448 bp, Amaranthus palmeri
ggtgtttatttgggcatggccttatgtgtgatgttggtaaattttgtggcttcgtccactaatctgatgtatcggatctgttaaagggagccctctcatcctatgcttatcaatgactttttcatatgcctatcaaacagatcagattggatcgggttcgagttcaggtcatatataaacatgtcagcaaacccttgacccatacccaacccatttagttaattggcttgaaaatcacaaccttaattcgaccagcgacagatcaggttgacctgatttcgacccacttaacccatttataatttttttttcgatttaagttttttaacattgattaaatctaattttttaggctttaattttaattttatgtttttttgtttaatttgtatttactatgaaaaataagaaactattatatgaactgagtttagcttacacttattaatttaactcgaaattaacacatttaattaaatggttatatagggttttttagttttaaaatttcaacctgaacctaatctatttaataaaaagatcagatctgatcaacccatataattaattgggtcaaaatctcaactcaaacccatttatttcgaattaaattcagatcaaattagcaggtcggatcaactagcgctaatttttcctctcaagttttttcatatgatgccccttgttttctttgaataaaattcaccaatttaaaatccctgcccttgatccgttggtattggtatttggtaaagcacatatggtaaattctactccattgttatctgtagttttggttctaaaccccaaacaaatcctactcctagcaccactaatcctcattactttctgtttgctgtctttctctacattcctactaaattaagacctagatgcagtgttattctgttcgaggttgccgaaaacggtacaatagttgcctaatttgcaattcatgtttgttcttgcgttttctacattgtttactctattggaacaaaggttgaactttcagcctttcagggagtattttgatttttctgtcaaattaccttgccagatttatttggctattttgattgtgtgtatttctttgtcccttgtttccatggggctaaactccttttggttaatcttaaacatttcttctaattttgaattgcagtggtatgaagtgttgtttaatatacaatcaatttttctgaactgggttaatgaagagaagcattgtagacatgaggaatgtgttcaagcatctcaaaacaaccaaattaatcccaaatgggatcttcaactgtaatagaggtaaatcacatatattctcatttaatggttattgttttattttaaggatgttattatgttgttatcaatgatagaaataagagaagcttgagcattcaaatgtatctatcactcactggttgtggacatctaaaatatggaccaagagttttcttcatttcttgtaccagaatttgcaaatgtatgattaaagtttaggttggagttgcaataaaatttcattaccccgacgctattaagtggctcacactgaggcggggtttgagggtcggatggtgcaaccttcaggagaggttctaagcattttcaacatgttcaaccgcagagggtcccgtaaaattggaggcttcaatattaaattatgtagtatgtgttaagtgtttaaagatataaaaatgttaatgaatacataatttttaaaattgcacagggctttcaaagaaatttttgattttgctccgcccatggcaacctttggcaaatctggatagaattagagaaatttacttttatgtatgtataatctgatgaatgaatgaatgaacaatgaagttcatttctgagtcaatgacctatatactatcgaggtttcgttaaataggatatataaataaaattagagacatcttttatccctaatgttgtctgttttcttttctgggcgagactgtttttggagaaaaacgttatgttgaatgcttgatttactcagaactgatgcaaacagatggataaaaaatggtgttttcctagtgtttatgtttcataaaaggatttcaaattccaatcgtatgaagtttgaaatactgctttttgtttttgtagcttcgtgttttgctttccttcactcttcaccagggaacgttgttgaagtttgttccaagaagcaagaagtcgtaattgcaatcgggagcaatgttggtgacagattagaaaatttcaaccaagctctgcaacaaatgaagaaattaggcatagacatcacaaggcatggttgtttatatgagacggaacctgcatacgtgactgatcaaccgaagtttcttaactctgctttaagaggctttacaagacttggacctcatgaattattaggggtattgaagaaaattgagaaggatatgggtagaaccaagggaataaggtatggtcctaggccaattgacttggacatactattttatgggaagtttagggtgagctctgagagcctcactatcccccatgaaaggatatgggaaagaccatttgtgatggcaccattgattgattgtattgggtctgatgtagaaaatgacactatttgtacgtggcattcattatcaaatttttcgggtggaatctttgaagcatggggtaaactcggtggaagctccctaatcgggaaggatggaatgaaaagggttttgcccgttggaaatctcttatgggattggtctcataaaacctctgttatgggagtcttgaacttgactcctgatagctttagtgatggcggaagttttcaatctgtcaatactgcggttgctaaggttcgtcagatgatctcagatggggcagatataattgacatcggggcacaatcaaccagacccatggcaactagaatttcggctgaagaagagctagcaagagtagtacctgtattagaagctgtcaaggatttgatcgaggaagaaggaagaatcttgtcagtggatacgttttattctaaagttgctttggaggccgtcaagaagggggcacacattgtgaatgatgtctctagtggtaaactcgattccgagatgtttaatgttgttgcggaccttaaagttccttatatagcaatgcacatgcgaggagatccgacttcaatgcaaaactctgagaacttgacctacaatgatgtttgtaagcaagtggcttcggagttgagttctagggtcatagatgcagaattatcgggaattcctgcttggaggatagttattgatcccggcatcggattttctaagaatacgaatcaaaatttggaaattcttagtggtttacaaaagatacgggaagagatagctaagaagagtttggcggtggctcattgccccttgctaattggaccttcaagaaagaggtttctgggcgagatttgtgagcgccctgtagcagctgacagggatcctgctaccattgcttctataactgctggagttttaggtggtgcaaacattgtaagagtacataatgttagggataaccttgatgctgtcaagttatgtgatgccatactcggaaaaactgattaactgcttgtttgtaccaccttgtgaatgatgtctagtggaaggttcgattgggattatgatgaagtccgttagtttgctcgaaagaagagctttagcccgtaaggttatagttcttacagatgtagaatcattggctatttgcctatttctgcttagaagatcatagcattgatccagactttggattccatgtagaattatgttgcgactcatggtcgaattggccctttgaggaattgttgaagttccttgagtctatggttcaatcggctcggttcgatgaaggttggactgtgtcgagacaagatgggtcaaagagaccaatggacaagaagtcgaccttgggcaagcttgatcaagttacttggacgagcagataacagcaggctctggcgagcattagacatacatatcatttgttttttgaagtcagatctgcaatcaatcagttgcaatggacagaccatatacggttgttagttgttcctgtcactctttgagttgaattagatcatgcaaacactgtaagagtcttgattttgtgaagctatgtgatactgtacttctcaaaatgaaatctttgatatgatgttagcttcaagagttgtttttccccccctcacattctgttctatgttgtattgttgtgtgctttttggaattgtattcctgtaattagaattattcctgcaaaatggtattcctttatatcatcaaaggagtttttgtacttctaatcattgatctttagatgcaaaactgaattaatacaagtgttcttgatgaaggcttattgaagaactcactttttatttatgtctaaacttgttaaagatgttctgcttccgcccttgccacgggatgtcgggattgactaagggtggtaatcgagggattcctatgcttgaattgactcgtttaagattttgcgttgattttaagtcaaatgttttgctaagcataaactattctagctcgacttgaataatgaagttttcgagtcaagtccgagctgttctgtaagtttatgtatcttgaagcttcttagttcttacttcttatccttatttgtttgacacattgaaccgcgttgatgcttgcttgactcaacccgttaaagtcttgaattcatcacgaattcgagtcgagcaagtttaaacccaacattaactaagctctcgaggcttaatgaggcaggggtagctcaagtttgttattcaagcaacttaccatagtattcttttaaaaggcatatagtcagttagttatttgttaatttcagtagaacgaaagaagtacattattaaacttggccattgatgcttgagctagagagcttcggttgtgatcgaaacgaatcctgatttcgctcttgatctttgatgtgaagtgacaaggccttcataaaactcctttattcttcagcagtgcatacaaaaatcatgtgtgcccagctcctagctcacataccgcgtttttcccctaatctagtgtggtcaaataaaaacagcaagatgtgttgatgtcatgtgcaatagtaattatcaggtgaagtaatgcaatatgtagccagtcacctcatatcaaaaaaatgttgggaggaaaacgtattcgttcatcactaaacctgtgtttatacatctaactgatcgatcagggtttcaaaatccaaattaatacaatggcatttgacgaagatatccagaacacatcccccttgtttctgctagataatcaactattctgattctgctgtaatacctcagcttcggccctagccatgggatcgtcctctttttctccttcacgctcctcggccagtttctttctgtgcagttcttcagcagcttctattgaagctttgttctcggcctgaagacgctgcatttcctcttccatttgctgcctctcaaaccatgtatcagcatccgcccaaactgcagacaagtatacaaaagttaaataacgaaagtcttcaaaactgcagatccagtgaacaaagtcattgttgccaatgcccatgcaaaccgcaaaacagcagggcaaaagaacacaacattgcagcataaagagcaagttcagtgatctacagttactacaaaatttaggtttgggataccagcatgtcaatatgaatgaatttgctaatacatgtaacccaagaactataagtctataactaacaattaagaaaagaaaaccagaagttccctaccactggagtattagcaaggtaacgactgcctgctgataagaattattggcctggaagtctggaactatgtgatgatcaacatgtgttgctattctaggtaaaactaatctatcataatataattaaactacaggccccagaattggggtcctgagctattgatcatgctgttaaagcaaaagagttgggctgaatgagactagcaattaaaagcataggatacactgaacaatgcttccccctccccatccaaacacgtaggttttagttacacaatagtggcttgagctagaaaaccataaggatatcatagtggacacatcatagttaagttttacataaatataccttatacatgtataagcaatacatttccaggttgataggtcagttttatgtctatattgatcgccattctattatgagggaattatattccaataatgggtaatcatcaatgagcagtatttataggaatttattgatagcgtttctattattaggatatagaaattccaataataggtaatcatcagtgagcagtaattgacttatcagactctctggcagcatagtgacaacatgctgtttgtgaaaaggggataaccatgattttgtcttttctttgcaaatgaagctcttt

SEQ ID NO: 10 - DNA, 5240 bp, Amaranthus palmeri
attatatgtcatgtaatataaatagaaaattattatttaaataattaatttcaaactttgtatcaataaaacacttaattttttgattattagagtgtatatgaaaaatatgtaaaaaaaagtcgtacataagaaaatttcattgtaattaagactaaatttgatgaatcgattcgtaaaattgctctatgatcctacaacccacttatttatttcaattaggactgtaattaagtttaaatttacattagttgaattattgccttttatgagagatgtggtatcgtatgctatctaaaggctaaaactattaagtcgatttaaaatctatccaaattttatacttaattgaactaggttgaattgaacggagaattaatcaaaaatgtaccacccttgaatcactatcaatattaaagcaaaccaactttaatccataaatgaaaatcaacttagtcaaatcacatatgaacccgtcaatcatgccaaaaactctgagagtgtttgatattataacttattagaaaattttaacttatttgacgcaaatagacggataagtgttctaaccatctagctctagtgtttcgcttaataaaaataaataatttttaaacatgctcctataaatcaactgatcaaaccggtttataaaatcaccaactaaatcgacccattcaaatcaaataccaactcggtcgtttgccaaacacttcgctatgacttcaatcaaacaaaatgcaacttgtttgctgctaccgacttaccgccttacccagtacgcggaaaagataatcaatgagaatcaaattcaaatcttgacaagataatatgattatcccattattatcaatttaattatgattaaccttttttaagataacctaataattcattgataagaatgattagcttgtttaatcaacttcaatttacaatttctaccttggaaaattcaaaccaaaaagtgtaaaagaattgatttggcagattgcgacaattggattgagaaattgacaaatttaaactgatcttatggtaattcaatccataacccacctttcaccaaaacttgcattgccatcgccattgtcaatttccgccaagaactacccagtagctgtaatgggcaacatttctgagcgggaagaacccagtaagtcaacctttcttcatatatcttaagcaatcccttttgaactacactttcttttgatgattttacattctgaattgtttttattggggattttcagcttctgcgaaaagggttgctgttgttggtgctggagttaggtaaattttatgttacttttccagaaagattgtgaaattttgctttgattgttctgaattttgatgggtttttgcataatgatttgtatttgggatgggcaaatttttcagaagatcatactactttttaacttgtgttttctgtagaattttattgattttctaaactgtttttgtgggattgttctagtggacttgctgctgcatataagctaaaatcccatggtttgagtgtgacattgtttgaagctgattctagagctggaggcaagcttaaaactgttaaaaaagatggttttatttgggatgagggggcaaatactatggtaatgtttatcaacaatgctggttttctgatatagaaccaattacttatttattaactggatttttggtcaaacctgtggttggcatgtcactttatgctatgattgtagacagaaagtgaggcagaggtgtcgagtttgatcgatgatcttgggcttcgtgagaagcaacagttggtaagttttccgtctaagcccattccctttgctctctaggtgcaaaaatacggtaatagtcatgatcgtggtaatgacatggtgatgcggtgacgggagttatgtgatcgctattccaactataggtcgaaaacatgatattttccttgtgacgttccgaaatgcggtatttttacacctttacattgcggggaaaaataggtttagtttttttgaatacctttacaaggcggctgatgcgatgaagccttgtttttgcattatgtgctagaagcaaattattatatctttaattaatgtaatgtatcatcagcttaaaacagccttattgtacttcttaatctagttttgacttttgaggttgcttttacgagatccttataaattgctttttctgtcacagccaatttcacaaaataaaaggtacatagctagagatggtcttccggtgctagtaagtcctctgcattttcttttgacctctatgaacttctaacactggatactgagttgtatttgtattcgaggcaaattctatattttccaatctgtttcttattgacagttacttgcaacctttgcagctaccttcaaatcccgctgcactgctcacgagcaatttcctttcagcaaaatcaaaggttatttatgctaaaacatgtttgtttgtttttttttaacttagcttttggtgtatgcaataatttggtttctaaaactaagtgattgaccgaaaaggagggacaaaggacatagaattgcaaatttttgttcttgacgtatttttacttttagagcatccccttgtgtaaaacttttattttagagctgcaagaatttgttgcatcttttgttatgatttaattttgatgcttttagctgcaacagtttgttgataaaaaggccactgcttttttctcagctgcaaattatgttggaaccatttctctggaaaaaacgcaatgctactgagctttctgatgagcatgttcaggaaaggcaagtgcccttgctctatctatactgatggaaaggattatcgctgaatttaccttctactgaaacatcaataaaatacttcattattagcatcaaaatactccctccatccttctggttttgctggactttccctatgaaggtgttcaaggagtagcttgctacctttcaagatagggtagtggttgccttctcgcaaaatttcagtcactcgttttcctctcctaattcaagccatactttttatggttcctccacacaactcttgctaaatttgaaaagtagcaaagaggaagtgagcaaaatcagcaggagtaggactgatgagtaagagcttgatcaagtataaaggatatgtttctatgtagaatatgaatgcattacctgtagaattgacataatgatttgtctgcagtgttggcgaattttttgagcgacattttgggaaagaggtattgttgccaacttgccatgctctattccggtgaattaacaaatgttgcgcttctgcttactattgcttataattattgtttttttgcagtttgttgattatgttattgacccttttgttgcgggtacatgtggtggagatcctcaatcgctatctgtaagttaaatactgtgccttctttttttttctcaaaattttctggaggttgtaaataaattatactccctcctattataatcaactgtcctatttccccttttggtatattcaaagtgagttaaatattgccatccattaaatttcactttgtcccttacttattttttcccttactcactcctctcatgtggtcccttaaactcggtgcattaccaaataggactattgattgaaataggagggagtatccgattgtgcttccaaaggtagttcaactcctcttctttttctttaaatttttgtaccatactgtgcattttgaaccttaactcatttcgccatgaaggagtattatatttgagaagaacgcagatactattatcttatacattaggtttcattatcaatgattgtttgattgtcaactcctcttttccctttcatgctcatattgatgttatttctatttggttatgaattttgtgtattgtgttaatgtcttactttattgtagatgcaccatacatttcccgacgtatggaatgttgaaaaaaggtatgaatcttaaagctttaattttcttcgaacgttatgtttcataattgattctttgggatcaatttccgtaagaacgataatttgaaaaaatttatgaaccttcaagctttcttcgaatttatatgctttgtaattcatgcttttagatgctgcaccattttatctatgtgtcttaagtttggtgtaatcatttgtatagcaaaagaatgaatggtctggtttgaaatggttcatagtgcaaaatgtgattgtgcttgcgattgaggtaacattcaaggtgatgcgattgtcgtactgtcaattgtcgtcctataccatgtgatatttgaataagcctaaaatgccatattgtacacctttaggatgtggacaaaatgggttcggtttcggtacatatgacaaatccttgcaatttgatctgtacgatacaatgcgattttgtcttttgctttatgatggtgattccatatgcgattttagggcttagaaatttcccttgttcaagaacatctcaatcaatctttaaccaatttcaaccacattaaattgcgtcaaagtcgaactttataattcactcccaatctctgagatatccaaactccaaaagttctattggctttcatgttttcacaaagtaacgttggtgggactccttaccattttctttattatgcatttcgttgatgtataatagtatagattggtgctcttttcgctgtccttctaacatgcataacttcactagttcttatcgttttcttttcctccctatttttatttgacttgtagctatctatgttcactcttctcgcccaatccaatgttatcttctactccatgcttgcaaaagccacaaaatgctcactccaccaataagaggaaattgccagtccaccacttgctggaggcatccatggaagctgaagtatttttgtcctctactcataggatgcatacatgcatcgatttactttctaatactcctttaacttgattccgattagctctgctcttaacaggtgttgctagaaaacatcaactattttcagcataaattaaatgtgagcattacctaataacgtgaaaactatcaaatcttgtttgtagtgcaatattgcgttttcggttgcggttgcatttacgatcgcaaagcgaatttcttggtcaatgtggatcgttctgcacttgcctacattccatcataataagctcaaatttgtttcattgtattttcgtaacaagaacaaaattattgtgtaattcttccctca

SEQ ID NO: 11 - DNA, 2936 bp, Amaranthus palmeri
tcagatatgtcttcataaagtattcaagtttgagcatgaaaatccacatgtacatgacatgagtatgcaaatgcaagtaatacaaacacataggcaaaagagatgatgtaatcactattcggtaatcgctcgcgcacaaatagtagctcactatatgaatgagatgagaaaatttcaattgttgtaaaggcgagttccttatgttttagtccaacagtgttttgtaacctttgtgtaattttttatatgaagcacaagagcaggtctcaaataagtacaggagataaatgaaactagaaataaaagtgttcaatatacttggacatagtcacatagttaatgccaaaatccatctttctgataagttggggccacttatacactatactaacatgagcctggaaagaaatagccagcaggaccgcaggtatagattgttagctaggaaaaccacaaaaccatactccctccatattaaaatgacattaacaagtgattagtaatgtaataacctacttacatattctaacaagtgattaatttcaatagtattccgacaaaatgtagctttaataattatcttccatctcatcaaatttgtttgggaaatttgtaacactgatcaatgactctagcacaaggaatagctaaaattatcatcatcatcatgatcatcttgactagtgtatcccactcataaggaaactatgatcagggtctggaaagggaaggaaggcgacaaatcataccataaagggagtttagaggtaatgaatacctaaatcctgatcctaaaacaattgatcttccccattaccacgccaatatcaacccacaaagcatccggggaaagtcaaacaaagggaaaaatcacaattgaaatatcctagtttcaagtttcaaccaattgggtaccatttacccatgttcaagtgtagcaaaaaccctaatatagcatcttaatacagctccagtaaacattatgcagtcttaatctgaagctactataccaaaacgactaacatttaacaaatgccattccaccattaaaaaaaagggtgttttagcggtaatgagttgatcggtcaatgtcaatccgagtaagaaaaaattaacacaatgcaaacccatttgccatgtttcaacacacaaacacaaaacactgataattccacaaatctgatactacaagcagcacaacagtcaattgcaaacataaccaaaaaaagctaaataaacagcagaacctgggatcggaaaagggtggtcggcgtcgtgaacaaactagagagagaaagatgaatatagagagataaaggagtgagaaagaaggaaggagagtaagcagaatgaaatgggtagtgtggagtgtggaataatggttgaaaatgaagtgtggctcttccatagaggatagggatgctgaaattgagtggtgaataaacaatctgaacaagatttggagaatgcaaaagaatctctggactaaattaatggaaaatcaaattgtatgtaatgatttagatatttaattagggttcttgtttgtgtctactcattctgtcactcacatgcatgctcattgtttgtatcaatctaaagccaagcattgactttttgggaaagccaaatagagaaaacaatatcctaaaggggaaatggactcataaaacgtgattgttactcccacctacagatgttcattcgggtcatcgagttgatttagggtcaggtgtttcgggtaggttcaaaatcgggttttgtgttcacattgatttttacatgattttaaattcatattgacgtcgggtcaagtcggattagattattaactcgggtaaatatcggatcatcgggtctgttttgaacacctctagtattttccaagttttgttgtatcacacatgcttgttgtggatgacctaaaattctttactgctgaaacgggacattctgtgttgcgttacatttggtttttagtagaatataagtttcggtgggttgttaaggcaaaaaacaagcagatgagaagaaatgtgtggctgagatgaatagagagatttttgcggatagaactaggaaagggcacgtgggttcatatccgtaagtaaaaagttagcatataactatagaacaccgaaaaatgaaaaatgtagcgaattgataagtgatcatatgcaatataaagttctggtgttttctgatatattcttttgtgactaaattgaacgggaaaccatcaaaaataatcgtctgtcaaggtattgaaaatcctaacttgggctatcggtgtaggtaaccataagggtggactttcagtgggaaaagcgatggcctccggatgcaaggctgcggaacttgtaatatcctatctggactctcatttatatgtgaagatggatgagaagaccgtgtaattcttctctgggaacgtcccctgattttgcgtctgtatatccgatgatatgtcgttggattgatcacgattgtagtcacgtttaggagttgtgcagtgacttttctgcctaaagactggatctgttagaaacaaatagtctatagatagtttctttgctcatcaggttatctttcttacaccagttgtgtatacaaatgttgcatagcctaacctaaattctaaaatgccattcccttttatatagggtcatgttttttgcatttatgaatggtgaaattttagatcttcactgagaataaaggttttggcaatttcataatggtgcttattaggggtatttaaaaccggatattggcaattttcattgataatattgtaatggaaaaatgacgttaaatatctttttcggtttacgtatcgaaaaatagacaaaaaggtacttgtttcgaccagatttacaaaagagttatcccattaggttaatcacgacgtccgtttttttgaaaaaaaatcgtta

SEQ ID NO: 12 - DNA, 1923 bp, Amaranthus palmeri
taaaaatgacgttaaatatattttatttttattttgttaatttatgtgttttaattataaagtattaaaaaatacgatgattaataagatactgctacatagacaacttaacctctcaaattggtcaaacccttaaacttaacggttaactaacgttttccattaagtgatagtcatttgcagagatttatattagattaggtagttttttgcaaaaaaaaaaattacattaggtagttttttgcaaatagacctatagattaggcagtttcttataatttttccttcttattatttgttgtttcagatatggcttcaagaatgaagtttggtaaccaaacttttcaaatttgaagtgagggttggagctctggtgttggaagccttttttgtaacaccccaaaaattttaggcaaactttatacgtttgtttatccaaaaaaaaaataataaataaataaaaaaaaaaaaattcttaaagtagaaccacttaagggtcggaggtctaggtaataattttggagtgataaatgtaaagattgaagagtttgtaactcataccattagttcactcatttacctcaatttatgattataattaagtattacaaaaaaaaggggaaacaatcacttcatattccaaaggtgaagcttttaatagtgaaggaaaaggatttcttaagcaatacagtattaaacgtaaactaaaaaaaataataaatcatatcttaattttgagaagttttattcttaatttgtttatccctatcaatactaagcttgggataataaacaaagggttatcaaggttggaggatttttaatttcgagattatatacttgaattgaagaaattttatgttcaagagaattatattagaggaatatttgtaaggctattatctacaattcttcatatttctctaattgaaatatatataaaggtaactagtttaccctctcttttcttaattcatatacattgttattttttttattatatggaaaatataaaacggaaaaaaaaatgtaaattaaacttatcttagttttgagataattgatgttatatagtcttataatgttgattaacgttgaaaattgaattacaaaactaaataatttaaacatatgatttgttaacttctactaattaaatcttggttaggggtgatttagttgatttgagaaatatccaaataaataattagattagtttggtgaaataatatttttttttgacttcgaaaacaatgggttaatttggcacactaatttggaatgtacaaataagttcattagagtagagcttcttaaattatgttttggtatagttaaaagtgatgttaatgtatggttaatattttataaatattttatatattttgtttagttgaattggccacttaatgaatttgtacattgctgttaaaaaaaaagagaggatattaatcgtttggtacaacagcataattgagcaaatcataaatctgccaaaattcaagtaattaaaaataattatcaattaacagttatacaagtgtatgtatgtggcattagcctaattgattgcgcaaggactaaataattacttattcaggtaatttagtattttatccaggttaattagaggttagttgagttgattatgatcaatattttggttaaatataaattttggcaaagaaaaatgagtattaatattgtatttattttgagactcgacaatttttagttgaattgttactttctaagatgttaagagtgttgttgacatagttgtacttttgagtagaataacactatcattagtacctctttgccaagagttagtaatagggttgacttttgttgacttagtcaaatttatagttgactttattcccaaactcagacattactcataacatcaattttggtatt

SEQ ID NO: 13 - DNA, 2787 bp, Amaranthus palmeri
acataaaaccgctacatggaggcacggttttgtgtcaaatgtaaaccactactccatgtagcggtttggtgcacatacttttcaactctcagtgtgttgctgacgtggacggtagtgcgggaattattttacaaagtaacgtaaagtgggaattttttttaaataagctgcattttgggcaaagactctacttttacttttaattttatttttaattttaataaagaaggaagaaaaaaaacaaatgtatttatggataaagaatccttgatttgaagataggataaccagagagagggcaagagagatgagtgccatggcgttatcgagcagcattctacaatgtctgccgcactccgacatctctttccgcttttctgcttatacaccaacccgctcccccatcttcttcggaagaccacgaaaattatcatatatccattgttccacaagctcaagctcaactgccaattaccagaacacgattacgacccaaggagaaggagataaagtattggattgtgtaattgttggagctggtatcagtggactttgcattgctcaggctctttctactaaacacattcaatccaatctcaatttcattgtcactgaagctaaaaatcgtgttggaggtaatatcactaccatggagtccgatggctatatctgggaagagggtcctaatagtttccaaccctccgatcctgtgcttactatggcggtaaactcattcttctctctttctccaatttttgatcattctattcaattttccccttattgagtcaaaatcaaattccaggttgacagtggattgaaagatgatttggtcttgggagatcctaatgctcctcgttttgtgctctggaatggtaaattaaggcctgttccttccaaacctacggaccttcccttttttgatctcatgagctttcctggtaagattagggctggtcttggtgcacttggtcttcgtccttctccccctcctccttcttatgaggaatctgttgaagagtttgtgcgccgtaatctcggcgatgaggtcttcgaacgcttgatcgaacccttttgttctggtacctaccctgtttaatttttcagttttcccccttttttctctactactcctactttattgattcttatctatgagtgttctatgggaattgacattaattgttcaggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccgtccgtaatcaccattactcattgctttccttcaccttgtatcttaccttaatatacatgtatttaattgataatgtcacattgcctcatttgcagccgccttcctaaacctaagggccagactgttggatcctttaggaaagggctcattatgttacctaccgccattgctgctaggtatcttttgactctcaaatcttaaatatttctcatcttttccttctgctaatactagtatgtttaccatctttttatttttttaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagtgagtatcattctttccttcatttcttttcgtttattgctgtccaatgtcttgttaaacaccagtttggccttgtgctcgtgaattatggctacaatgttaactgattctgtgattcaggcactgtgggagatgcctaagtttctaaaacctctgcgcataatgtttgtttggatgttaggaattgcattgaaaaattgcttttgtgatgttgatgttaataccaattacaagtgtgttcttcaacttctgcaataccttgttcgagtgagcttgagggggtttagattagtgtccaatgtgaaactagcaaatgaactccaagcgctgggataggtccttgggatggagcccctgatacccaagacagtattcaaaccctctaagtagagtgagagatcaaggaaagaaactgggtggttcctcaaatcgtaaaaaatgaatacagtgtcatgattgctaatcttatcacaaatcgtaaaaaatgaattatggtcgattttggactatttttgggtcattttgagtgaatctcaaacttaaaaagcgagtcttctagcagttcttgttacagcggggcatacataggtaggaatttggttttttactatttgagccttttgactgttgtggccggtaatatggaatagtctagcacttctgcgtgtgtacaactagtatttattgtaattatgtgatcgcacttaactctcagataaaaccttaagcactaacattttgttttggttgaaggaatcaggaggaaagaaaattgagggatttgttggtatatagattcctttgtttggataacaaaattggagtggagagatttggaaggaagaattttatagggattagttcccattacacttatgttgattacaaaatttctccaaaagtggaaagattttgagtgaaaatgttttttatttctcttcctctccctttctttccctcttaaacaaacaaggaaagttaatcttatcattccgtaccttccccttctgttct

SEQ ID NO: 14 - DNA, 2379 bp, Amaranthus palmeri
attattgtgtaattcttccctcacgtctctattgtcttcatttttttagaaaaataaataaagcttggttttatagattttgtaactgatatgcaatacatttgcgtttgctttcagttattgattcaaaaacaataatgctaaagccctaatcctaacatgttgtgtcatctgttgaaacaatacttgaaatcgctataaaaagggatttttgtcgggtacttcagttgttgaaattgatatggtcaagtacaattcattttaacccaatttgtaatgatttactggcttggtttcttagctgtttgttttaataaaggattttagttcggtatttggttgttgaaaaaattgatatggccaagtaatggtcatattaacacaattggtaatgttttattagctcaatagtgtttgttaagtatgtgactcaaatttaatcaagtataacttattgaagcgtagttcttttatccattaggtttggctctgtgtttgctggactaattcaatcaacattgttatctaagaaggaaaagggtggaggagaaaatgcttctatcaagaagcctcgtgtacgcggttcattttcattccatggtggaatgcaggtataaccttatagccataatttcgctttttataccttatacttccaaaatatattgatgcattttcttgctacaatcacaaaagctttgggaaaaattctcaattttgtcaaatctactaaaataattcattttggaaccaaggttttctatttcagaatacatggatgaagacatgcagtaagtatggataaaataatctagatgtaaaaggtttttagtctattaagcaagaatattataattcagagtcgtttcatcaataaagtgttgtttaagtgcagcaattacattctgcttcaagcaaaggctatcttaagacttaagaggctcccaaaacatgaggaggtatgagaccttagaggccaaagaaataaaatttgatgaggagacttggtgagataccttgcttccaaaaatgatatatttttccccttagacacctcagattatgacatttataaggtgtccctgcgtattcgacgagattttacgacctatactctaaagtctaaattgagtgagaaatgtgtatatgtgtaagaaaggaaagttagtaccatgaattccatgtctacgacctcaaagtgttcataccattgaaattagtgagcttacaattgttaagaaagcatcaactattcataattgatcattgatgaagtgtgtaatagacatgctaggtgaaattcgaaagggatctactctgtctttgagtttacaatttgcttctagtttttagctatttataggtgctatcaaagggttgaatattgttttttctgaacattgttgccgagttgtgaagggagaatgatggtagatttctcttaatgagaacattctcttcataaagagttcgatagcgcaaaaacgaaagcttattgccaaaagtggctggggtagatgaaagagaactgcaattgattttgctaggcttgactttgagtaaagaattcatggcataaggtagaaaaataggagatggctgaatgatatcgaaaccttttgattctttttgttttgtttgcaatgcacagaaaggcaggacgggaaagtgtgattaaatggatgggaaaaattgctagaatagaaaagaagaaagatgtagcactcacgtgaggaaattacccaatatctgaatggagctcacactcctctcttcctctactaatatacaacctgcctaatttgcacaatagctgctaatatcatagtagtatgagataatggctggatgtctcaattgttaccctagttttgacaactattttacgttggcatttcggtggcctggggccgtggactgagtcaccttaaaaattcatctgtgatatagtttagaatcaattttgaaaatttaggcaggcctaaattttgataaagatagcatgatctaaagaatgcagctctaataaatttacataaaatttgatattaagtagtctctgtctaggcctgccttccgagcttgtatattaactgagcgcatgtttatttgaggaatagcataggagtcatttttttgcatactaattagcatgtcaattttattccatttgctgagtactgtatgttctgcagacacttgttgacacaatgtgcaaacagcttggtgaagacgaactcaaactccagtgtgaggtgctgtccttgtcatacaaccagaaggggatcccttcattagggaattggtcagtctcttctatgtcaaataataccagtgaagatcaatcttatgatgctgtggttgtcactgtgagttttt

SEQ ID NO: 15 - DNA, 760 bp, Amaranthus palmeri
tcaaattggtcaaacccttaaacgatcaactaacgttttccattaagtggtagtcatttgcaaagaaatatattatattatgtagttttttacaaaaaaagaaaactacattaggcagttttttgcaaatagacctattagattttttttttaatttttccttcttgttatttgctgtttctaatgtggcttcaaaaatgaagtttggtaaccaaacttttcaaatttgaagtgagggttgggaagccttttggtgtcccttctattaagagttggggcctcacaatcactagataacgtgcctttctctcatgccttacctttctaattcttagaatagaaaaaagacggtgaattttttatacgctgtatgattacattttttgaaatctctccgatcatcttgatcatgggatggaattgttcgtgcacatgttttttaagaatggaatctaagcatagtgtattagagagaatgagtgaaagttagtggaaagaaaaattgagttggagaataaaataaaaaacaagtgggtaatagaaataagtggttacgatgaagagggtgtataaatttgtagataagattaaaaggggtgggagtaccattgttataaaagaaaagagtgcaaaatccgttggacgaatttaaataaaaagtggtgtaaaatgaaaggaacgacaagaatatgattttcccagctataacactgtcacaaatgtaattcatcaatatcttttcaacatttctctaataatt

SEQ ID NO: 16 - DNA, 1872 bp, Amaranthus rudis
gcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggtgatcctgcaaagttgagtatgaaagctgcatttggaaaggtctggaccttagagcaaaagggtggtagtatcatagccggtacactcaaaactattcaggaaaggaaaaataatcctctaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggagaatacaatctcacttatcaaacacccgatggaccggtttctgttaggaccaaagcggttgtcatgaccgtcccttcgtacattgcaagtagcttgcttcgtccgctctcagatgttgctgcagattctctttctaaattttactatccaccagtcgcagcagtgtccctttcttatcccaaagaagcaattagaccagaatgcttgattgatggagaactaaaaggattcgggcaattgcatccccgcagccagggtgtggaaaccttgggtacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcatgagatacagtcggtgttcattgagaggatagatgcaaataacttggacggaaaaaaaaagaaaaaaaaacaaaacatgtcggccgcctcggtctcta

SEQ ID NO: 17 - DNA, 1605 bp, Amaranthus rudis
atggtaattcaatccattacccacctttcaccaaaccttgcattgccatcgccattgtcagtttccaccaagaactacccagtagctgtaatgggcaacatttctgagcgggaagaacccacttctgctaaaagggttgctgttgttggtgctggagttagtggacttgctgctgcatataagctaaaatcccatggtttgagtgtgacattgtttgaagctgattctagagctggaggcaaacttaaaactgttaaaaaagatggttttatttgggatgagggggcaaatactatgacagaaagtgaggcagaggtctcgagtttgatcgatgatcttgggcttcgtgagaagcaacagttgccaatttcacaaaataaaagatacatagctagagacggtcttcctgtgctactaccttcaaatcccgctgcactactcacgagcaatatcctttcagcaaaatcaaagctgcaaattatgttggaaccatttctctggagaaaacacaatgctactgaactttctgatgagcatgttcaggaaagcgttggtgaattttttgagcgacattttgggaaagagtttgttgattatgttattgacccttttgttgcgggtacatgtggtggagatcctcaatcgctttccatgcaccatacatttccagaagtatggaatattgaaaaaaggtttggctctgtgtttgctggactaattcaatcaacattgttatctaagaaggaaaagggtggagaaaatgcttctattaagaagcctcgtgtacgtggttcattttcatttcaaggtggaatgcagacacttgttgacacaatgtgcaaacagcttggtgaagatgaactcaaactccagtgtgaggtgctgtccttgtcatataaccagaaggggatcccctcattagggaattggtcagtctcttctatgtcaaataataccagtgaagatcaatcttatgatgctgtggttgtcactgctccaattcgcaatgtcaaagaaatgaagattatgaaatttggaaatccattttcacttgactttattccagaggtgacgtacgtacccctttccgttatgattactgcattcaaaaaggataaagtgaagagacctcttgagggcttcggagttcttatcccctctaaagagcaacataatggactgaagactcttggtactttattttcctccatgatgtttcctgatcgtgctccatctgacatgtgtctctttactacatttgtcggaggaagcagaaatagaaaacttgcaaacgcttcaacggatgaattgaagcaaatagtttcttctgaccttcagcagctgttgggcactgaggacgaaccttcatttgtcaatcatctcttttggagcaacgcattcccattgtatggacacaattacgattctgttttgagagccatagacaagatggaaaaggatcttcctggatttttttatgcaggtaaccataagggtggactttcagtgggaaaagcgatggcctccggatgcaaggctgcggaacttgtaatatcctatctggactctcatatatacgtgaagatggatgagaagaccgcgtaa

SEQ ID NO: 18 - DNA, 1238 bp, Amaranthus rudis
gagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtcccttcatacattgcaagtagcctgcttcgtccgctctcagatgtttgtctgcagattctcttaattaattttccttttcacaattcgcttttacagggttttccttcacctacagaaacaccaaagttaagaaatctgattttaccctccaatttatctccctga

SEQ ID NO: 19 - DNA, 635 bp, Amaranthus rudis
ggccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcatgagatacagtcggtgttcattgagaggatagatgcaaataacttggacggaaaaaaaaaagaaaaaaaaacaaaacatgtcggccgcctcggtctctactga

SEQ ID NO: 20 - DNA, 5704 bp, Amaranthus rudis
attaagttttgatgtttttagctgcaataatttgttgatgaaaaagccactacttttttctcagctgcaaattatgttggaaccatttctctggagaaaacacaatgctactgaactttctgatgagcatgttcaggaaaggcaagtgccacatactattaagtgttagttgctgagaatatatttgaatctaagatgcacgaagaccactggtgcccttgctctatcaattctgatggaaaggattatcgctgaatttaccttctactaaaacatcgataaaatacttcattattagcatcaaaagattccctccatccttctggttttgctagacttgccttatgaaggtgttcaaggagtagtttgctacccttcaagatagggtagtggttgccgtctctcataatttcagtcactcgttttcctctcctaattcaagccataatttttatggttcctccacacaacacttgctaaatttgaaaagtagcaaagaggaagtgagcaaaatcagcaggagtaggactgatgagtaagagcttgattaagtgtagaggattttcttttgtgttgaatatgaatgcatcatgcatgactgtagaattgacataatgatttgtctgcagcgttggtgaattttttgagcgacattttgggaaagaggtattgttgccaattgccatgctctattcattccggtgaattaacaaatgttgtgcttctgcttactattgcttataattattgtttgttgcagtttgttgattatgttattgacccttttgttgcgggtacatgtggtggagatcctcaatcgctttccgtgagttaaatactgtgcttgcttttttttttttcaacattttctggaggctgtaaataaattatactcctttctattctaatcaaatatcctatttccccttttggcatattcaaatttagttaaatattgtgtaaattatttacacaattgccattaaattttcacttttcccttactcactcttctcatgtgtcccttcccccttttcttaaaattggtgcattatcaaataggacatttgatttgaataggcgggagtttccaattgtgcttccaaaggtagcttgtcactttttctttttctttaaattttgtaccatgccatgcattttgaacctcaactcatttcgccataaaggaatattatgtttgagaagaacgaggatactattatcttatagataacatataggtttcattatcaatgattgtttgattttcaactcttcttttcctttcatgctcatattgatgttatttctatttgttatgaattatgtccattgtgttaatgtctttctttattgtagatgcaccatacatttccagaagtatggaatattgaaaaaaggtatgaaccttaaagctttaattttcttcgaacttaatgtttcttaattgattcttttggatcaatttccataagaatggaaatttaaaaaagggtatgaaccttaaagatttcttcgaacttatatgttttgtaattcatgcttttagatgctgcaccattttatctatgtgtcttaagtttgttgtaatcatttgtagaccaaaagaatgaatggtctggtttgaaatggttcatcgtgcaaaaatgcgattttgcttgtgattgaggtaacattcaaggtggtgtgtttgtcgtactgtcaaatgtcttcctataccatgtgatatatatataagcctaaaatgatatattgtacacctttaggatgtggatagcaggggttcagtacatatgaaaaatccttgcaatttgatctgtacgatcaatgtgattttgccttttgccttttgccttttgttatatgatgatgattccatgtgaaattttgggatttagaaaattcacttgtttaagaacatttgaatcaaactttcaccaatttcaaccacatttaattgcggcaaagccgaactttaaaagtcactcccaatctttgagatatccaaactccaaaacttctattagctttcatgttttcaccaagtaaagttggtgcgactccttaccattttctttattatgcatttcgttgatgtataatagtatagattggtgctctctttgctctccttccaacatgcataacttctagttcttgtcgttttcttttcctccctatttttatttgacttgtagctatttttgttcactcttctcgcccaatccatagctaaagaaacttgatttcattgattttgtaactgatatgcaattcatttttgtttgcttttagttgttgattcaaaaacaataatgctaaagccctaatcctaacatgtcgggttagctgttgaaacaatacttgaaattgctataaaaagggattttttttcgggtacttcagttgttgagattgatatggtcaagtataatttgttttaacacaatttgtaatgatttaatggcttagtttcatagctgtttgtattaataaaggaaggaggactatctgaaattgcaataggaaagagattttagttcggtatttggttgtttaaattgatatggccaagtaatgttcattttacacaattggtaatgttttattggctcaatagtgtttgtaagtatgcgactcaaatttaatcaagtataacttattgaaacataaataaatatccattaggtttggctctgtgtttgctggactaattcaatcaacattgttatctaagaaggaaaagggtggagaaaatgcttctattaagaagcctcgtgtacgtggttcattttcatttcaaggtggaatgcaggtataaacttgtagccataatttcactttttataccttatacttccaaaatatattgatgcgtttttcttgctacaaagtacaaacacaaaagctttgggaataattctcaattttgtcaaatctactaaaaatattctattaggaatcaaggtttctattttagaatatatggatgaagacatgtagaagtgtgaataaaaaaacctagatgtgaaaggtttttagtctattaaacaagaatattagaattcagagtcgtttcatcaataaaatattgttgaagaggagcaattacattctgcttcaagcaaaggcaatcttaagaggaccctaaaacttgaggaggtatgagaacttagaggccaaagaaattaaatttgatgaagagatttggtgagataccttgcttacaaaaatgattaattttccccttagacacctcaaattatgacatttataagttctccatgcgtattcgacaagatgttacatcctatattctaaattaagtatgaaatttgtatatgtgtaagaaagaaaagttagtcccttgaattccatgtctacgacctcaaagtgttcataccattgaaattagcgagcttacgattgttaagaaaggatcaacttgtcatcattgatcattgatgaagtgtgtaatagacatactaggtgaaattcaaaagggatctactcagtctttgagtttaccgtttgcttctagtattttgctatttataggcactatcaaagggttcaatattgttttttctgaacattgttgccgaattgtgaagggagaatgatggtagatttctcttatttttatgagaaaattctctttataaagagttcgatagctcaaaaatgaaagcttattgccaaaagtggatggggtagatgaaggagaaatgcaatcaattttggtaggcttgactttgagtaaagaatttgtggaataaggtagaaaaataggatttggctgcatgatattgaaaccttttgctacttttctttttgttttggttgcaatgcacagaaaggcaggacggtaaagtgtgataaaatggatgggaaaaattgctagaatagaatagaagaaaaataatggcaggatgtatcctttgttaccctagtttcgacaactgtgttacgtcggtattatcggtggcttggactgagtcatcatagaaattcttctctgatatagtttagatgaaatttttaaaatttaagcaggcctgaattttgataaagatagcatgatctaaagaaggcagctctaataaatcaacataaaatttgatattaagtagtctctgtctaggcctgctttccgagctagtatattaactgagtacatgttattagagcaatagcataggagtcatgtttttgcatactgattagcatgtcaattttattccatttgctgagtactgtatgttctgcagacacttgttgacacaatgtgcaaacagcttggtgaagatgaactcaaactccagtgtgaggtgctgtccttgtcatataaccagaaggggatcccctcattagggaattggtcagtctcttctatgtcaaataataccagtgaagatcaatcttatgatgctgtggttgtcactgtgagtttttgtctacttttgtctctatgagcatgcaattcctttcacagccgttgagttagcaattatattccagtttgaaacttaaagttttttgggggaatttttctagcattcaagtcaatcaaggcttatttggaactcaaagctttatctatgttatatgaaactacaataaaatgatttctaaaaaattaattgcgaatagcggagattcaattagggtgtataattgatccacatcaaatagcatgcattctacatgttagtcacttgtggcttctctagtcctctgtctccagaaaaagcctgcatacaaaggctcatgaagactagtatgctatatactttccgaaatgtcagcattaagtaacttgtgttgaggaaatatgtaaatcgtaccctgttaccctctttttaaagagtgattttttttttaattgaatgtggttatagctatctggtttgatgaagatttaccattcttaatgaagcaaaaaattttaagttcacaagtttcaattatattaggcatttaggctgctatacagtgaattggctcgataaattttgcgcatgtcttatttatgtgaattgtagataacgtttgctacaaagggtcaatcaagaacaaccttttcatttttgtaaggataactcctaaattctgcctaggttggaggatatgtggaagtcacttaatggcaataggactgaaatattgttgaatatggttatctagtaccaattcacacttgtatacatgagtacatgtctaatgctctttgttgtgatttacttaaacaagaattatgttcattagcaggctttcatgctctctgtacagcaccttatctttcctttaccacgatactatttgtcttgtttaattatacatatatcataaatgtttcgacattcggtctaaaatattttggatgggtgtatactgtttaatgcaacaatatgtaaaatagatacataaagaaaagtaaaaggaataatgaattacaaaaaatacgatgaaaattgaaaatggatgttgtatttcaaaaggaggttaaaggagtgatttgcttccaaagtagaaatcattccgagttcgtagattgttttaagaataccgagtgtagtatggattatggtggacaaaattttctataatattttttcataaacaatagtgaagcaaaaaattattggcgaaacaggtgtcagcttaaaatttccttttcacatggttattttcgtcatagctc

SEQ ID NO: 21 - DNA, 1031 bp, Amaranthus rudis
ttttaaccaatcctcaaaatttacaccatggagatgtctgcggataagaattagtaactgtagcagctgtaattgttgcatgcagttttatggtttgccttgcaattcaaacttgggatattgtttgccttgcaatttgtagtttagtgtttgcccttcactttgtattttagttatttttttcattgcaatttgctctttgaagtataaaatggtgacctttcttgctcaggatgttgctgcagattctctttctaaattttactatccaccagtcgcagcagtgtccctttcttatcccaaagaagcaattagaccagaatgcttgatcgatggagaactaaaaggattcgggcaattgcatccccgcagccagggtgtggaaaccttgggtatatgctcccattcaactatatctcaataattatgagtatttttctttctctggattattcaatttggtgacgttaaattttgactgtactcgacaggaacaatttatagttcatctcttttccctggtcgagcaccacccggtaggaccttgatcttgagctacattggaggtgctacaaatcttggcatattacaaaaggcaagtcatttatacaattatatgtgtccttgtatcctcaaataagtcgtatcaatcctgacgacatgcttctatcaatgcagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgccttggggaggtgtatagagggtgcttatgactctgcttctgaggtagtggatttcctctcacagtacaaagataagtagtccatagggctccagcatcttggttaagtaactttttgtagctgttgtaattt

SEQ ID NO: 22 - DNA, 1017 bp, Amaranthus rudis
agagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggtaaactgattcttctctctttctccaatttttgatcattctattcaattttccccttattgaatcaaaatcaaattccaggttgacagtggattaaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtacctaccctgtttaatttttcaattttcccccttttttctctactactactttattgattcttatccatgagtgtactatgggagttgacaataattgttcaggtgtctatgctggtgatcctgcaaagttgagtatgaaagctgcatttggaaaggtctggaccttagagcaaaagggtggtagtatcatagccggtacactcaaaactattcaggaaaggaa

SEQ ID NO: 23 - DNA, 630 bp, Amaranthus rudis
  unsure (1)..(630): unsure at all n locations
  misc_feature (272)..(272): n is a, c, g, or t
gtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtacctaccctgtttaattttntcaggtgtctatgctggtgatcctgcaaagttgagtatgaaagctgcatttggaaaggtctggaccttagagcaaaagggtggtagtatcatagccggtacactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgttggatcctttaggaaagggctcattatgttacctaccgccattgctgctaggtatcttttgactctcaaaccttatatat

SEQ ID NO: 24 - DNA, 612 bp, Amaranthus rudis
acactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgttggatcctttaggaaagggctcattatgttacctaccgccattgctgctaggtatcttttgactctcaaaccttatatatttctcatcttctccttctgccagtgccatactaatactagtatctttaccatatattttttatttttttaggcttggcagtaaagtcaaactatcgtggacactttctaatattgataagtcgctcaatggagaatacaatctcacttatcaaacacccgatggaccggtttctgttaggaccaaagcggttgtcatgaccgtcccttcgtacattgcaagtagcttgcttcgtccgctctcagtgagtatcattctttccttcatttctattcttttaatgctatccaatgtcttattaagcactagtttggcgttgtgctcatcaactatgactataatgttaactaatag

SEQ ID NO: 25 - DNA, 487 bp, Amaranthus rudis
ttgatttgaagataggataaccagagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggtaaactgattcttctctctttctccaatt

SEQ ID NO: 26 - DNA, 1582 bp, Amaranthus spinosus
agagagagtgcaagagagatgagtgccatggcgttatcgagcagcattctacaatgtccgccgcactccgacttctctttccgcttttctgcttatacaccaacccgctcccccttcttcttcggaagacctccaaaattatcatatatccattgttccacaagctcaagctcaactgccaattaccagaacacgattacgacccaaggagaaggagataaagtattggattgtgtaattgttggagctggtatcagtggactttgcattgctcaagctctttctaccaaacacattcaatccaatctcaatttcattgtcactgaagctaaaaaccgtgttggaggtaatatcactaccatggagtccgatggctatatctgggaagagggtcctaatagtttccaaccctccgatcctgtgcttactatggcggttgacagtggattgaaagatgatttggtcttgggagatcctaatgcccctcgtttcgtgctctggaatggtaaattaaggcctgttccttccaaacctacggaccttcccttttttgatctcatgagctttcctggtaagattagggctggtcttggtgctcttggtcttcgtcctcctcctccttcttatgaggagtctgttgaagaatttgtgcgccgtaatctcggtgatgaggttttcgaacgcttgattgaacccttttgttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaacctaagggccagactgttggatcctttaggaaagggctcattatgttacctaccgccattgctgctaggcttggcagtaaagtcaaactatcatggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagatgttgctgcagattctctttctaaattttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggcatattacaaaagagtgaagatgaacttgcggagacagttgacaaggatctcagaaaaattctgataaatccaaatgcgaaaggcagccgggttctgggagtgagagtatggccaaaggcaatcccccaatttttagtaggtcactttgatctactagatgctgcaaaagctggtttggcaaatgctgggctaaaggggttgtttcttggtggtaattatgtat

SEQ ID NO: 27 - DNA, 1485 bp, Amaranthus thunbergii
agagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatatcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattctgataaatccaaatgcgaaaggcagccgtgttctgggagtgagagtatggccaaaggcaat

SEQ ID NO: 28 - DNA, 1808 bp, Amaranthus viridis
ggataaccagagagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatattactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcaatagggctccaccttcctggttaactaacttttgtagctcttgtaatttgtatcatgtaatattattcagatgtaaaagatacagtcggtatttattgagaggatagatgcaaataactt

SEQ ID NO: 29 - DNA, 1829 bp, Ambrosia trifida
ggaacatcaaccagataagactttcccccaataaaaatgtcatctctcacaaacctcccttccctgaaccactaccgcacctggtcttccccacccattccccatcgaacccaatcatccaaaccccctaaccacctaaccacctatggtcccaccaataacaaccacaacagacgtacaacaacaaccttccgttgctcaatagccaacgacactccaatctctcctccaattaccaacgactccaattctaaacccttactggactgtgttattattggtgctggaatcagtggtctctgcattgcccaagccctagctactaaacatgctgacgtgtcacctgatgtggttgttacggaagcacgtgatagggttggaggtaatatatcgacggttgaacgtgatggatatttgtgggaagaaggtccgaatagttttcaaccgtctgatccgatgctcactatggtggtggatagtgggttgaaagatgatttggttttaggggaccccactgcaccacggtttgtattgtggggtggtggtttgaagccagtgccttccagtccagctgatttgcctttctttgatctaatgagctttactggaaaactcagagccggttttggtgctctagggatccgccctccaccaccagatcgtgaggaatctgttgaagaatttgttcggcgtaaccttggtgatgaagtttttgaacgcttaatagaaccattttgttcaggtgtttatgctggcgacccatcaaaacttagtatgaaagcagcatttggtaaagtttggaagctggagaagaatggtggtagcattattggtggagcattcaaagcaatccaagcaaaaataagagtaccaagcctcctcgggacccgagattaccaacaccaaagggccaaactgttggatcttttaggaagggacaagccatgttgcccaatgccatctcaaaacgtttgggtagcagagtgaaagtgtcatggaagctaataaatatctcaaagttggagaatagaggttataatctgacttacgaaacaccaaatggatttgcaagtctgcaaactaaaactgttgtcatgactgttccttcctacgtggcgagtgacttgttgcgtcctctttcgtcggaagcagcagaggctttgtccaaattttattaccctccagttgctgctgtatctgtttcctatccaaaagaagcgattcgtgctgaccgtttgatcgatggtcaacttaagggttttggtcaattacatccaagaagtcaaggcgttgagactttaggtaccatctatagctcatcccttttccctaaccgggcgccacctggaagggttctcctccttaactacattggaggggctacaaatcctggtattttgtcgaagacggagagtgaacttgtggaagcagttgaccgtgacctaaggaagatgctcataaaccctagagcaggcgaaccgttgactttgggggtcaaagtgtggcctcgagcaatcccacagtttctaattggtcattttgacattttggatgctgcaaaatttgctcttagtgaaggtggatatagaggtatgtttcttggaggcaactatgtttctggtgtggctttaggtcgatgcgtggagagtgcttatgacgttgcagccgatgtaagtacatttttgtcacgaggcgtgtataagtgatactgttatgtagcactttggaatactttcttgtgaggttagtggttacctttttgtcacaaggcaggtacaaataacaagccaattattggagttcaataataataatttttgtgtaggtta

SEQ ID NO: 30 - DNA, 921 bp, Ambrosia trifida
gactgacagagaaaccaacaatggcttcaccaactatagttgacaaccaaaaacctgctaagagagttgctgttgttggtgctggtgtcagtggttgtgctgctgcttataagttaaagttacatggattgaatgtgactgtgtttgaagctgatgggagcgttggtgggaaactaaagagcgtttcgcaagatggtttaatatgggatgagggtgccaatactatgactgagagtgaggcagatgttagcagtttgattgatgatcttgggcttcgagataaacagcagtttccaatttcacagcacaagcggtacattgtaagaaatggaaaacctgtattgataccttctaacccaattgcactgattagcagcagttttctttccactcagtcaaaggttcaaattcttttagagccatttttatggaagaagactaagtcatctgacgaacccgagagtgttggaggattctttcaacgtcattttgggaaggaggttgttgagtatctcattgatccagttgttgcgggaacaagcggtggagatcctgaatcactctctatgcgtcatgcatttcctgagctatgggatttagagagaaggtttggttcaatcatttctggggcatttcaatctatggtatcttccagaggtgggaaaaggaaaccttctggaaacagcaaacgtaggcgtggttccttttctttttttggtgggatgcagacactcactgatgcactatgcaaagagattggaccccatgaagttaatcttcaatcaaaggtgcttgaaatgtcctacagctgcgatgataatgcggttggtaattggtcaatttattgtgctccagatcaaaacaaacaatttcagcaatcttttgatgctgtgatcatgactgccccacttaacaacctgc

SEQ ID NO: 31 - DNA, 811 bp, Ambrosia trifida
tttctagcaatcttttgatgctgtgatcatgactgccccacttaacaatgtaaaagaaatgaagattacaaagacaggaagtccgtttctgcttaattttattccagaggtgagttatttgccaatatcagtaataatctccactttcaagaaagaaaacgtgaagcagcctcttgagggttttggagttcttgttcctgccaaggagcaggaaaatggtttgaggacactaggcaccctcttctcttccatgatgtttccagatcgggcctcagaagacgtgtacctttacaccacctttgttgggggtagtcgaaacaaagaactggccaaagcttcgagggacgagttgaagcagatagtaacttctgacctcagacagttgcttggaacagaaggggagccaaaatttctaactcactattattggagcaaagcatttccattgtatgggcgtgactatggttcagttattgaagcaattgagaagatggaaaaagagctacccggttacttttatgcaggtaaccacaaaggagggctctctgttgggaaagcaatatcctccggatgcaaagcagccgaatccgtgattgcatatttggattcttattcggaccagaagtagaaggatgggtgttgctagatgatgttttaactggattggccggagaatgtagatcaaaagagtttttgttcgctagagcgaggataaatttgacgaaaattcagcatggcttttcgttttgtgtttttgaaggtgagcaaggatggtgttgtataaacttattgttgagtaaattataactaa

SEQ ID NO: 32 - DNA, 4915 bp, Ambrosia trifida
cgcacgcaatggttttgcacttttgcccacagtaaagaaaaggtagcctctctacccgacccgacccgacccgaaccaaaccgataaaaacaaataccaactctgataaccagattactcacagagaaaccaacaatggcttcaccaactatagttgacaaccaaagttagggttcttctaaattctaattacattttatcctaattttacttacacatttgtagcatttgcatctataattcagaaacctaatctaatttattaattaattaattaagtggttttgttttctctacagaacctgctaagagagttgctgttgttggtgctggtgtcaggtacttaaacttaaaacctaaaacagataattattttgcttatttactagattcacttattctgttcatgtaatttgctaaggtttgatcagtcaattatatacatttagggatttaggagttacagaatgttttgatataataatatatacaatttgtaaaaatatatagatcatgattgataattagaggaatggaatattttgataattgaaaaaacaatatgttacatttttttcagtggttgtgctgctgcttataagttaaagttacatggattgaatgtgactgtgtttgaagctgatgggagcgttggtgggaaactaaagagcgtttcgcaagatggtttaatatgggatgagggtgccaatactatggtatgttttagtataatatgattggtttcactttgttagcattttttatgaggtttgttgtatgtgttaccttatgtagactgagagtgaggcagatgttagcagtttgattgatgatcttgggcttcgagataaacagcagtttgtaagttgttgtgtttgatatagctgccatacttcctatagcttgtgtggtaaattatatctatgaacatatgcaattattttgtaaaatgacaagaaacagattctttgttttatttgtgtatgaataatgaatagataagactaaattcatttttaggtctgcttcgatttgtcttttataatcactacgctgagttttaaatctttaacattatttcctgttgcagccaatttcacagcacaagcggtacattgtaagaaatggaaaacctgtattggtatggatatctcaacaccacttaactagtgatcctctatttttagtaaaattcatttactaaaaaaaggggggctgaaaaattaaaatttaatgtgaattgtgctttattaggtttgaatgcttaacctcatcaaagtcaaataataacatgagtagtctgttgctctggaaacccgtattgcaacccatgaaaagatccaaatcacggtttttcaaacactgttttatacttttatgtccagggaacaaaaaaccaaaatctttcctgagtgaggccttagttgtcttcttattatttatcttttatatttatcaagttcatgtctctctatattgaccatgactcagtctatatcatgattgcagataccttctaacccaattgcactgattagcagcagttttctttccactcagtcaaaggtatgttagtagctcctgccaccttgaaggttcaagcataagtatgccatatcttattgagatcgttcactcgcatactatcttcttaatgttgttcaatgttgagattaaagtgcaatctttattctattttgcttaatcaaatataatgtttatttattttaattttattaaaaaagtatctacgtaagtattacaaaaagtaaaaactcttccccgttgatgagatgatctcaaagtctaatgtcatatatctagtactctcaataagctaacataaacagtatagtctattaaaagggtccccaacatcgaaatgagtaacgctgctttgagttaagggtgcaaaatgtcatataataaataaagatgttctatgatgctttgatatttgtttcgcactttcacttatcccccatggtatttttaacttgtttttaaaagtagaagattttttttattgatgtgcatgcgattattatcggctttgtttgcaaattttacaggttcaaattcttttagagccatttttatggaagaagactaagtcatctgacgaacccgagaggtaaaatacatagccttgttccatttcatcggcttgaagtagttatattcggtacatgccattaggttcttaaccatgtattttgcagtgttggaggattctttcaacgtcattttgggaaggaggtgtttgtatattcgacataatgttttgtttctgttctgattctgtttctcatagttattaatatttgacctgcttatctaaggttgttgagtatctcattgatccagttgttgcgggaacaagcggtggagatcctgaatcactctctgtgagtaactattgtttctccacacatttttttggagaaatatacattgctgctttacattaacgaccttaaaccgtttaatatattgcttgaattcttttacttttccacacagatgcgtcatgcatttcctgagctatgggatttagagagaaggtatgtttgtaacaaacagtagtaattcttcttcaaacgatctgtggaataatgacttttgaccacttatttctgaagacctaaaatcaatttaatacttacaactatttaattcaggtttggttcaatcatttctggggcatttcaatctatggtatcttccagaggtgggaaaaggaaaccttctggaaacagcaaacgtaggcgtggttccttttctttttttggtgggatgcaggtaagacgagggtgatttactgatttagataagaccctaaatttagttattgttatcttttaattaattacagatgttatttgggtcgttcatgcttttttgctatgcagacactcactgatgcactatgcaaagagattggaccccatgaagttaatcttcaatcaaaggtgcttgaaatgtcctacagctgcgatgataatgcggttggtaattggtcaatttattgtgctccagatcaaaacaaacaatttcagcaatcttttgatgctgtgatcatgactgtgagtgccttcattgggtaatcttttacttatcagtgacataaagttagttaatttcttgcattcttgatgaagatagttttttgtatctttaaagtttattctgtgtcctctaggtagtatctggatattaatacatgggatgggaatttttttaatcttgagtttttctctgatggttattaagtgttagatgcatctaattttaactgacaaagaaaatattccccaattaggccccacttaacaatgtaaaagaaatgaagattacaaagacaggaagtccgtttctgcttaattttattccagaggtatgtttttttttcttctactaaagcattagttttagttctatcaaatctaacactgaatacagaaaacagctttaacatcgtcatccaattaaattgtgaaatatttatagtgtcatttcttagccttttgtttttataatacaggtgagttatttgccattatcagtaataatctccactttcaagaaagaaaacgtgaagcagcctcttgagggttttggagttcttgttcctgccaaggagcaggaaaatggtttgaggacactaggtgaagcttgattctgccctccattattgttttttatttgtttacattgacaccatagcaaaaattctgctatgcaggcaccctcttctcttccatgatgtttccagatcgggcctcagaagacgtgtacctttacaccacctttgttgggggtagtcgaaacaaagaactggccaaagcttcgaggtaggcaggcttgctcatcaccatattcccccttaaaattgtagtgtgaacttaactcaagttctaattaattttttgtgcatatgttcaaaatctatgatagccttctgaaagacaaagtaaaaaaagtctttactgattaattgtggtaaaatcaatttattcataatgacgttaattgacaaataggtcttggaaactttcctagtagaggatatgttgtaacttttaactcaaaaatctttcttgcaaaatagggacgagttgaagcagatagtaacttctgacctcagacagttgcttggaacagaaggggagccaaaatttctaacgtaagggcacaacgctatttcagtttaacagtaatctttgctagaataagaaatgtaaccgcttgcctacctatggtctttttatctgttaaacaaaattttgtttaataaccactagcctggtgtagtggcaaaggtgtatctccctcatccaagaggtgttgggttctagtctcacttgagacaaggggaacattataagcggagtaaaaaattagccgtttaaaaaaaaaaaagtttgtaatttgaagttttccatcatgaactgaaacagttgctaaaatgtaacaagaagttattaaagtcttgaggtacatagatatatacacaatgtaaatatggcttacggagttgtgaggttgattgcagtcactattattggagcaaagcatttccattgtatgggcgtgactatggttcagttattgaagcaattgagaagatggaaaaagagctacccggttacttttatgcaggtaacatgttttgtcttgaaaataaaaatggacaaatcatatgttgatgagtagaggtggcaattttgacctattataacttacagagggatagatactgccatactggttacgtatttctttaatgggtcacacgggtagaaataaaaatatagctcgggtcaaaagaagcctaaagtttattctgagcatacaacttcctagtcgtcgtatttcagaaattaaattcttatgttaataagataattttggt

SEQ ID NO: 33 - DNA, 851 bp, Ambrosia trifida
ttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagcaatatcctccggatgcaaagcagccgaatccgtgattgcatatttggattcttattcggaccagaagtagaaggatgggtgttgctagatgatgttttaactggtaaactttatttcttatatcttattttttttcttatttttcaatgcaaagagtcaaacggcgcaagtgtaatatcaggattggccggagaatgtagatcaaaagagtttttgttcgctcgaggttggataaatttgacgaaaattcagcatggcttttcgctttgtgtttttgaaggtgagcaaggatggtgttgtataaacttattgttgagtaaattataactaatgacatgtttgaataatgtgttagaaaaaaatgaatcttataattgaaaataatatgatcaatttatgatagtgttttcatgttagatataatcaaagtatgaaatcttatatcctaagaatggttatatatggtttagtaggttaagtgtgttttgacaatgatgcataataaggatttaacttggagaaacggtgacgtggacagcttgaagcagacaccccaccagatcgatgtttaagtagtactgaacattcatatgtttgttccaccaaaatatctagttgcaaactatttttctttttgttttataaataaaattaattaattttttaatata

SEQ ID NO: 34 - DNA, 507 bp, Ambrosia trifida
atcccaccgcttttgcgctttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagcaatatcctccggatgcaaagcagccgaatccgtgattgcatatttggattcttattcggaccagaagtagaaggatgggtgttgctagattatgttttaaccggtaaactttatttcttatatcttatttttattcttatttttcaatgcaaagagtcaaacgacgcaagtgtgatatcaggattggccggagaatgtagatcaaaagagtttttgttcgctcgaggttggataaatttgacgaaaattcgcttttcgttttgtgtttttgaaggtgagcaaggatggtgttgtataaacttattgtt

SEQ ID NO: 35 - DNA, 1648 bp, Chenopodium album
aaccctcaaaagaaaattttcactgcaatctttgtagccttcttgttagcaaaatactcggacaactaatcctagcaacagcgctatttgtttgagtattgtgagaggtaatccactacctcagctgcagattcataagcaccctctatacatcgccccaatgcaacacctgaaacatagttgccaccaagaaacaatcccttgaacccagcatcagttagagctgcttttgcagcatcaagcagatcaaagtggccaatcaaaaattgtggaattgcttggggccatactctcacgcccaaaacccggggatcttttgcattaggatttatgagaatgtttctcaagtccttgtcaactgccccagcaagttcatcttgcgtcttgtgtaatatactagtgtttgtagaacctccaatgtaactcaaaattaaggtcctaccaggtggtgctcgaccagggaaaagcgatgaactataaattgatcccaaggtttcaacaccctgactgcggggatgcaattgcccaaatccttgaagtttaccatcaatcaaacactctgatctaattgcttcactaggataagaaagtgacacagctgcaactggtggatagtagaactttgcaagtgattctgcagcaacatctgaaagtggacgaaggaggctacttgcaatatgtgatgggacagtcatcacaacacttttggtccgtacagaaaccagtccatctggtgtttcataagtcagattatattctccatttggcaacttaacaatactagaaagggtccatgatagtttcactttgctgccaagcctttcagaaatggctgtaggcaacatagtgagtcctttcctgaaggatccaactgtctggcccttaggtttagggaggcgcgggtctcgaggtggctttggattgttctttctttcctggattgttttgagggtaccaccaatgatactaccacccttttgttccaagatccaaactttgccaaaagcagctttcatactcaacttggaaggatcgccagcatacacgcctgaacaaaagggttcaatcaagcgttcaaatacttcatcagcccagattacgacggacaaaatcttcaacagattcctcgtgagctggaggagaaggacgtaagccaagagcaccgagtccagacctaatcttgccagggaagctcataaggtcaaagaaagggaggtcagtgggcttggacggtacaggcctcaatttgccattccacaacacaaaacgaggggcgttaggatctccaaacaccaattcatctttcaatccactgtcaacagccatggtgagcactgcatcagatggctggaagctgttaggtccctcttcccagatatagccatcggcctccacagtagtgatgtttccaccaactcgatctttagcctccgtgacaatgaaatttggggagcgggaggagtattttgtagagagagcttgtgcaatgccaagaccactgattccaccacccacaatcacacagtcaagtacttcagcgccatcgattccaacagtagcagtgtttgtgttctggtaattgactgctgaatttgaggtcgagactgtggagcaacagataatggtgttggtagcattattctgtgaa

SEQ ID NO: 36 - DNA, 1653 bp, Conyza canadensis
cgattcgagttcccggccattgctcgattgcgtggtcgtcggcgccggaattagcggactgtgtatagcgcaagcgttgtcaacgaagcacggcggcgacgtggtcgtgacagaggcgcgtgagagagttggaggaaatatatcgacagttgaaagagatggttatttatgggaagaaggtcctaatagctttcaaccctccgatcctatgcttactatggtggtggacagtggattgaaggatgatttggtgttgggtgatccaactgcacctcggtttgtgttatgggatggtgatctgaagccggtgccttccagtccatctgatttgcctacctttgatctgatgagccttggtgggaaactccgagccggttttggggctcttggaatccgccctccacctccagaccgtgaggaatctgttgaagagtttgtccggcgtaatcttggtgatgaagtttttgaacgtttgattgaaccattttgctcaggtgtttacgcgggggatccatcaaaacttagtatgaaagcagcatttggaaaggtttggaagctggagcaaaatggtggtagcattgttgggggagcatttaaagcaatccaagctaaaaataagagtaccaagcctcctcgagacccgagattaccaacaccgaagggccaaactgttggatcttttaggaagggacaagcaatgttgcctaatgccatctcaaaagggttgggtagcagagtgaagttatcctgggagctcgtaggtatcactaaatctgagaatagagggtatagtttgacatatcgaacaccagatggattggaaagtctgcagactaaaactgttgtcatgactgttccatcctatgtggctagtgacttgttgcgtcctctttcggtggaagcagcagatgctttgtcaaaattttattatcccccggttgcagctgtatctgtttcctatccaaaagaggcaattcgtgcggaccgtttgattgacggtcagctcaagggttttggtcagttgcatccacgaagtcagggcgtggagactctaggtaccatatacagttcgtctcttttccctaaccgtgctccacctggaagggttctgctcctgaactacattggaggggctacaaatcctggtattttatcaaagacggagagtcaaattgttgaagcagttgatcgcgacctacggaagatgctgataaatcctaaagcaggagagccattgaccttaggagtgaaagtgtggcctcgagcgatcccacagtttctgattggtcattatgacattttagaggctgctaaatgtgctcttagtcttgctggataccggggtatgtttcttggagggaactatgtatctggtgtagctttaggtagatgtgtggagaatgcctatgaggttgcagccgatgtaagtaattttttgtcacggggcgtgtacaagtaatacgtcactcttcggaaattagtgtttatgaggttagtaattaaagttttggcacaaggcatgtggaagtgaaaacgcggactttcagtgaagttagtcatctattctcaagcctcatggctaaatgtaattcgagttaatatactaaaaaaaaaagaaaaaaaaacaaaacatgtcggccgcctcggtctcta

SEQ ID NO: 37 - DNA, 600 bp, Conyza canadensis
ttaggtggaatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttgatgctgtgatcatgactgccccacttggcaatgtgaaagaaatgaagattacaaagacaggaagtctgttcctgctcaattttatacctgagcttagttatatgccagtttcagtcataatctctacattcaagaaagagaatgtgaagcggccccttgagggatttggaatgcttgttcctgccaaggagcaggaaaatggtttgaagacgttaggcactctcttttcttccatgatgtttccagatcgtgcccctgaagacttgtatctttataccacctttgttgggggaagtcgaaacaaagaactggccaatgcttcgagggatgagttgaagcagatagtaacttctgacctcagacagttgcttggagcagagggagagccacaatttttgactcactattactggagcaaagcatat

SEQ ID NO: 38 - DNA, 10631 bp, Conyza canadensis
aaaagtatatttaaaattttttgcccacaccaaaaaaaattttaaaaaaaagaagtacatatgcaatcaatgacatgcgatttcaatcccaactttcaaatctcaatttttaaatgctagtagctataagtaaataatctccattctccttctctatacatcttttcttattcaacaggtaatactttcatttattaatcataaaattatacatatatattttccctaatttttaggtttcttaatttcttttgacgtgaattgaaagatgaaaacgtgatgatagattggaagagttgaagaggggttttgttttggggaatctcatacataacacactaaacaacatattatcagttatcttgtattgatttaatataaaatatgagtactaaaataccattatatggatcgtataagtttagtgaatagttcgtgcttttggttatacgacgaaattgtagttggtttattatatcgtcttttgagtttgcattttggttgtaattggatggttattattttgtgggtatatgaatttattggaatttgatcgatatattaaaatttttgtacctatataatgttttaaatttgtcaccttacgataaagttcctggctccgccttgatagcagccttcatgtaaaattggttttcataaacgttctgagtttttataaattttgtaacatgtcattcttctggaaatatgcttctcttcaatttaacgcgtatatgagcgttgcattcgcatataatcgaatgtctcgtggaaagtactaaagacttggccaacgttaggtttcattatcatcttctaggggattgtttaagtccaacataattaagaatttacaaacagaaggaacaacgtaggaaaagtcataatcaattgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggtatgaagttgaaataatcgtttgttgttttcaattaacattttttcacaaagggagagagataaatatggtgatcagctttatatttcaatataatgtgaaaggtctgaaaaaaaaatttgaccaagtgtaaaaaatatgttttggataaataaaagttaatttaaataatctactaaaattagcccctggtttacaaatatcatttcacttataatttattaaccataatttactaatttgttcagtcaaacttttttttttatatagtttctttatttaacgtactcacaacacattacaatctctcatattgggtatttttactgctgcattacgtgagtttttttttattgtatcatataatttttgacaaatgatttttaataaaacaaaccttttcactctttaatggtgaggtttcaattccacagtttaatcaattgccgatcgatgtatatatgtaatttttagttttaatttagtaaatacaaaattatttaactagggtataggaagagtagacttgaaaatatgggtgataatttcttgattctttcaatttgagtaagttaaagaaatcttaactcttcaaattttggcctttaatttatatctaaaggttaatttttatctaaaggttaacattactataacttggactaattccctccctaaaaatatatacccattttccttatctgacttggaaaatagtggggtagatcggatctgacctaacctgatttgacccgatccgacccgaacgttgaaaatgaaaattagtttactagaggtggttcacccacagagaaattataccaaaccgaaacaacccaacaatggcttctccaacaacaacaacagatgataacaaaggtagatactatttctttttcttcttaataatcttaatatgttattattttcattgtagataatccagttctgcattttgttgcacagagaaagcacctgctaagagagttgcagttgttggcgccggtgtcaggtcaatgttactactttcatatatataatatatgtatcttgcgttttattttacttcttactttttacggcgaaatacccaaatatcccaccccacggaaggttatgtagactttggttttctttgacctctatagttggttacttgttatggccatgaaatgaaagattcctaaacgagggtggagattactctagcgtttgttttgaccccaaaaatgctttgcttgtcggaggacatgaccaatatttagaggactaggattagcttagcggaatatggtagataagtaatccttttaggggtactttatataattgtggattttcatgcatgatacctttcttatatgctcatatgacttctttgcactgttaggggtagtgttcttgacagctaggtgacctatgctactttgtttcataggtcgattagggattagcacccactatttttttatttttttggaaggcattaaattatattatattaaagataaaaattgccagtaagaaactagccgatacatagactgtccaatccaaaatagaaaactagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagtatcatcatactcgatcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatggctggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgccaatactatggtatgatatcgatgttagtttgcttatagacataacttctttttttttattttttttaaaaaaaagttgttttgatgctcttttactccgtatttgtagactgagagtgaaccggatgtcagcaggttgcttgatgatcttggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttttgttttctgggaatgtaaataattatggcagtttattgtactgttctttcgtatagatagttataaactcaaaacacaaaaaaaaggttgttttattacgcggtcgtagctgtcacaattttagttttcttttgtacttgccaagttcatgtcttatatactgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaacttttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgtaattcattctttaagtgagcttgattatttgttcccatgcaatctactatgattttttattataatatttataaagcttggattcttaaattcaatgtgatgacggtcaaatcaacatgcaggtttggttcactcatttctggggcatttcagtctatgatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatctttattctcatgcagacacttacaaatgcactgagcaaagaagttggacaacatgaacttaatcttcaatccaaggtgcttgaaatgtcctatagctgtgatgataacactactgggagttggtcgatctattgtgctccagatcagaacaaacaattaaatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtccgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcttttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttttaaaagcccgaggttcacagatacttttacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttatatatcatcctttcccacattgtctctaatcattacacgctctcatcgaccttttatcacccttcgccaccgccctcctccaccgcctctctcgatctccaccaccgtcttccatcaccttttagccgctacaacgcgcgggcattatgctcgttttaaaaaagcaagttaaaaaggatagtaggttgataagaatgactaaatgaggacaaatctattaggtaaccacaaaggaggacttgcagttggaaaagcaatatcctctggatgcgaagcagccgaatctgtgatttcatatttggattcatattccgatgagaagcgttgctagatgttgtggtaatactatttatgatacaaaaatgaatgaaattctgagcctgaaccatataatcctgcattttcttaattattattcaaagtgcaagacttttcaggtacgtgtacatctcaagaagttttctttccatcgggattggataaatatggcgaaaaaatagtgtggctttttccggtgtctttgaatgtagtcgaaggactaagctttagttacttttataatgcaataataatggatcaaagtgttgtagaaattgatcgttccggatgatgttaaacattgcaaaatgttgtaacaaaacatggggctcgggttttgcttaatttgcatctgtaacaaaggctcgccatttttgggtatacttttaactatctgtctcaaccaaatagtttaaataaacgtgcttgaattagttgtacttttattataaatagttaggggatgaacttttgatatagaatatacaaattttctattcaagttaattatagccgttagaaaaatccctaaataaaagccaatcaggttttaggttttttttttttcttgaaaagttttccattattttaagggttattccttgatggtgagccatttttgctcgttatagcggtctaaatagattttacctgtgaccggtgttatccattcacatggtcacctccaaaatatgcttaaggacatattcgaacttgaaatcttttgtgaggaaacatataattctttcgggttttgctaaacaaagctcaatgggtgtgcattaaatagttgtacacttaccataaaaatcaggggtgagcttttgatatgaaaaagtacaacttttttatgtactataagtgaaaccctaagggctttatttaacattttccaattctttatcactagataaacttgatgatggttagcttctttttttttcctaaacataggtgtcttactcacttagactagacccaaaagttgactcgctttgcgagcccaagtcagagtaggtaagtctctctttgggtcactagagtatttttcttaaggagtttcatccttttagagacatccccaatcaatggacctccaccctagtgttttggttggttaataatttagtattattatccctgttatatattcttacaagaggttttagattaaaacattttaggtaatattttaggagtggttagaaaagggttgatcggagaggatgtaaaatattgttacgcaaggggtcagagtggaaagataaaggccggtatagtctttcataggagtttgtgtcctcgaaattcacccaagaactttgtctttgtgctgtcgtacctttttctttttctttcccttttgtctgttactactccgtattaactgacgttttaatattgtttagcttaactaaatagattattggaggattagtatttgttgtttagtcattaattgaaggtgaatcaagatccgaataaatgaatctaaaacctatttgcttagtcataaatcttcaagaaaagatgaattgttttgcttaattttaatccttaaagcaaacatgaattgaactcttaataaaaaagagctaggtatttatgacggttattggctgctttaattaagctctttgtctgcatatcccgagtctatccaaatcatcaccccattatgctgtcggtgcttttaggacaaaatcattagtgttaagttcagtcttttaaaaccgttataaagctacaaatattagattcatcttctctacagagaggtgtatcttacattcttacacttaaaacggataaacagatgaattttttcttattttggtaattttttcgaactttttcactagtcgcttctaagattgtatataatgagattcgaacttgagacacccaattaaggatttgtgcctcgtaaatacatgagctgaagttaaagccaaatcactcttttcacttctaatacctagtagcatattcatcattcattataaaattttacacgttatagttgttcaattatttatagtcgtcattaacatctgtttgagaagttcatcaatttccagtacactggtaatcacttaaaaataattggagtcgtctgtagtcccccctcatatgtgagtactttttaaattcaagaggacccatagatctttaactacatttattgatttatacattatttcatatagcattttctgcagatacgatttgttatgtagcaacatagacccatgttcagtccaaacatactagtacaattttggagcaatgcaataatgagtatctaaagtttcatgtgagaataatcaattacttagacactagacgttttttaacaatcagtttgttcctggtacattggcaccaactcgtctgagccttcagcgcgttggccagcaagtagtttcggtttggtggtcactgtcgagcaattgggcacgttaagtattttttttacattttttatttcatatgtatctctgtgtgggtgggttgtaggtgatgtgaagaaggcgataggtcttatattagttttagaaagttttttttaaaaaaaatcctattctttaatgtaa

SEQ ID NO: 39 - DNA, 10185 bp, Conyza canadensis
atttttttatttaaaagtatatttaaaattttttgcccacaccaaaaaaaaatttaaaaaaaaagaagtacatatgcaatcaatgacatgcgatttcaatcccaactttcaaatctcaatttttaaatgctagtagctataagtaaataatctccattctccttctctatacatcttttcttattcaacaggtaatactttcatttattaatcataaaattatacatatatattttccctaatttttaggtttcttaatttcttttgacgtgaattgaaagatgaaaacgtgatgatagattggaagagccgaagaggggttttgttttggggaatctcacacataacacactaaacaacatattatcagttatcttgtattgatttaatataaaatatgagtactaaaataccattatatggatcgtataagtttagtgaatagttcgtgcttttggttatacgacgaaattgtagttgatttattatatcgtcttttgagtttgcattttggttgtaattggatggttattattttgtgggtatatgaatttattggaatttgatcgatatattaaaatttttgtacctatataatgttttaaatttgtcaccttacgataaagttcctggctctgccttgatagcagccttcatgtaaaattggttttcataaacgttctgagtttttataaattttgtaacatgtcattcttctggaaatatgcttctcttcaatttaacgcgtatatgagcgttgcattcgcatataatcgaatgtctcgtggaaagtactaaagacttggccaacgttaggtttcattatcatcttctgggggattgtttaagtccaacataattaagaattttcaaacagaaggaacaacataggaaaagtcataatcaactgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggtatgaagttgaaataatcgtttgttgttttcaattaacattttttcacaaagggagagagataactatggtgatcagctttatatttcaatataatgtgaaaggtctgagaaaaaaatttgaccaagtgtaaaaaatgtgttttggataaataaaagttaatttaaataatctactaaaattagcccctggtttacaaatatcatttcacttataatttattaaccataatttactaatttgttcagtcaaactttttttttttatatagtttctttatttaacgtactcacaacacattacaatctctcatgttgggtatttttactgctgcattacgtgagtttttttttattgtatcatataatttttgacagatgatttttaataaaacaaaccttttcactctttaatggtgaggtttcaactccacagtttaatcaattgccgatcgatgtatatatgtaatttttagttttgatttagtaaatacagaattatttaactagggtataggaagagtagaagacttgaaaatatgggtgataatttcttgattctttcaatttgagtaagttaaaagaaatcttaactcttcaaattttagcatttaatttttatctaaaggttaagattaccataatttggactaatcccctccctaaaaatatatacccattttccttatttgacttggaaaatagtggggtagatcggatctgacctaacctgatttgacccgatccgacccgaacgttgaaaatgaaaattagtttactagaggtggttcacccacagagaagttataccaaaccgaaacaacccaacaatggcttctccaacaacaactacagatgataacaaaggtagatactatttctttttcttcttaataatcttaatatgttattattttcattgtagataatccagttctgcattttgttgcacagagaaagcacctgctaagagagttgcagttgttggtgccggtgtcaggtcaatgttactactttcatatatataatatatgtatcttgcgttttattttacttcttactttttacggcgaaatacccaaatatcccaccccacggaaggttatgtagactttggttttctttgacctctatagttggttacttgttatggccatgaaatgaaagattcctaaacgagggtggagattactctagcgtttgttttgaccccaaaaatgctttgcttgtcggaggacatgaccaatatttggaggactaggattagcttagcggaatatggtagataagtaatccttttaggggtactttatataattgtggattgtcatgcatgatacctttcttatatgctcatatgacttctttgcactgttaggggtagtgttctcgacagctaggtgacctatgctactttgtttcataggtcgattagggattagcacccactatttttttattttttggaaggcattaaattatattatattaaagataaaaattgccagtaagaaactagccgatacatagactgtccaatccaaaatagaaaactagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagtatcatgatactcggtcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatggccggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgccaatactatggtatgatatcgatgttagtttgcttatagatatagacataacttacttctttttttttattttttttaaaaaaaagttgttttgatgctcttttactccgtatttgtagactgagagtgaaccggatgtcagcaggttgcttgatgatcttggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttggttttctgggaatgtaaataattatggcagtttattgtactgttctttcgtatagatagttataaactcaaaacacaaaaaaaaaggttgttttattacgcggtcgtagctgtcacaattttagttttcttttgtacttgccaagttcatgtcttatatactgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaactttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgtaattcattctttaagtgagcttgattatttgttcccatgcaatctactatgattttttattataatatttataaagcttggattcttaaattcaatgtgatgatggtcaaatcaacatgcaggtttggttcactcatttctggggcatttcagtctatgatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatctttattctcatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtctgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcatttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttttaaaagcccgaggttcacagatacttgtacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttatatatcatcctttcccacattgtctctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttttggtatcgatcgttgtgtagtgttgcacacctcacttgatattagttttatgtgattatatatggttaatttaatttttctttgatttttgatcatggtcttaaatatcattaaaggtgaagaaacatgtgaagagggataaatttggagaaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtatacatacattatatatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcgtacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgtaatttctttgaaatttataagtttcttgcaatgggtatatgattttctattgattgaagtggttaataacaggatttggtgagtaaagtttgaatctttcgagttatggatttatgtcataccttttcttgcccttcaaaataaagtcaaagctttagttttgtgatttgactttggtatcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatttgatgagttc

SEQ ID NO: 40 - DNA, 2634 bp, Conyza canadensis
cgtcaccatactgccacggtcgccacaccttcgtctctatcactatcaccgtcgcatcgcacggacatcatctagtcaatatttatttatgaggaatggagatatatctatactttcatattaaattaaactgcctatttttttcaactattctacctttgaaatgcctattataccctcctataaacaactatccattctactcttttaattgattttctcgtactacccttccatctatttcccaatacttatccctaatctctaatcccctcctctcttgctgtcgccgaaaacctaatagaaaaattagtttcatttctacggcaactaccataaacctacaaaaagattggttttatctctccctcaccaccaccaccacaaatcacccattccttacaagctctcaaatcggttaggtgattttccattgaaatcgcttgtttttattttattttattatatctaatttcctaatttaaatccattgtttttgtatttttcccaattttctttttgaatttggtttgggttaatgttctgatcatccatgtattttgttcgtacattcacaaaagaaaaaggtaccgacacatttaatgatcacttttttaaaggtaccgtcgcatcatgtgggtacccatctagctagttgatgaataaattattagtattgttaaatttaagttttttgtttaatgagtaatttaagagtatgtttaaatttgggttaaaaaaaaaagaaaaaaaaagtaaatgtgtattgatttgtaagttgtaaccgtctaatattataaaaagaaaaagagaaaccactcctatataaaacagtcaagcctcttgtatcattaaccgggttgatttaagagcgaactttgatcgaattttgggttttcgaatttgctttccatccacatcgatatctgcccaagtaagaaaccctcgttcctgtctctctttaatttacatctccatgtgcttttcgatcctaattataaatatgcggataaccgcagcattactacccgacgcccaaaggaagaggaaaaagtcgtcgtcaaaggcagatcaacaaatattgatatattgataataatgtaatagaatatgagaggcttccagccaagtccgcatgtcgtttcaagtctgtttccaaacactggaattcgttcctatccacacgtatgtttggaccaccagctccatcacatgaacaaatcctataaacttctcttacttgaccagctagccccctgtagataaggatttatgcagcaaacccctcaaccacgtacggttccattaccgtcggttttaatcgactggaggaagccgatcctagatttaattcgcttgtaggatggattggtatgtgtagccgatccttgatctatatttcaatttcactggctaggtgtaggcattattattaagcaatgtgatcgattgatggctaattcaggcgtttgaattcaacttttcattagtcaagtaattattctcaagtttatatattaatagtatatatacgatatcatagtataatatacaaaataaaatctatccaaaaggaataaaatctttggaaaggaataaaatctatccaaaaagaataaaatctatccaaaaggaataaaatctttctaaagatttcggacattcactataaatagtgacagcagatgagatggaaagaaaaaaagaaaaaaaggaacaagaatactcctttggagagaatacttgaactctcatccctcaaatcattgttaacataatcactaccctcataggattggatggcgtaaaaccgtatacgtaatacggttaccagcagggatcgccacccaaatatcctaatcttcctcacaccttcccatgctaggtggcatgggacccacataactctctttatttatataatgatattagattacatactccttgaaccgtaagtgttaatcgacgtatcatcatatatacactaatatctatgttaaataattaataaacaaaatatgacacataaaatttttgcgagatatttttggcgaagcattgcacaaaaagcagcaaggctaggatatttttggcccacaatgtaccgcgatgcaacaaagattgtcgacaattgtgataattgccaatgccatgctcctatcatacgtcaaccccaacacgacttgacaagtatttcaagtccatggccgttctatcaatggggaacagatatcgtaggaccattcccagaagcaccaggaaaagtgaaatttttggtagtcgcaatcgactattttactaaattggcagaagcagagccactggcaacaataactggacataaaatactcaagttcgtatggcgcaacattgtatgtcgttatggaattccaggaattatcatcagtgacaacggaaagcaattcgcaaataacccatttcgggagtggtgtgaagagcttaaaataagacaacaattcacttcagtcgcacacaggtcaaacagaggtaactaaccgcaccatcctacaaggcctcaaaacaaggctaaacaaggcaaaaggacaatgggtagaggagttaccaaacgtcttatgggcatacagaataacagcgaaaacggctacgggttgc

SEQ ID NO: 41 - DNA, 1631 bp, Euphorbia heterophylla
attgcgtgattgtaggaggtggaatcactggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaaccatggcggtggatagtggtttgaaggatgacctagttttgggggatcctacagcgccacggtttgtattgtgggatgggcaattgaggccagttccttctaagccaagtgacttgccgttctttgatttgatgagcattggtggaaaactcagagctggttttggtgctcttggacttcggcctccacctccaggacgtgaggaatcagttgaagagtttgtgcgccgcaaccttggagatgaagttttcgagcgtttgattgagccattttgttcaggtgtttatgcaggtgatcctgcaaaactcagcatgaaagcagcattcggaaaagtttggatgctggaacaaaatggaggcagtatcattggtggcacttttaaagcaatccaggaaaggaataaaaatcccaagcctcctcgagacccgcgtctaccaaaaccaaagggccaaacagtagggtcttttaggaagggactgactatgcttccagaggcaattgcatcaagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctacaactgctgctgaggcactgtcaaaattttattacccaccagtagctgctgtgtctatttcatacccgaaagatgcaattcggacagaacgtttaatagatggcgagcttaagggatttggtcagttgcatcctcgtagtcaaggagtggaaactttaggaaccatatacagctcatcacttttccctaaccgagcaccagatggaagaattttgctcttgaattacattgggggtgctaccaatcctggaatattggccaagaaagacagcgaacttgttgaagcagttgaccgtgatctgcgaaagatgctcataaatcccaatgcaaaggatccacttacacttggcgtaagagtgtggcctcaagccattccacagtttctgattggtcactacgatatcctagatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaacccagtatacttataaatagtatctgatgagatttaagcaagagttcaattatgctgcggctaagtactgtgagtttattgagtagtgggtaaaaatgttgctttaggtctgttgtatttgtaatagttgcttcacgtttttcattaaggatggtgtattctctagttatgcattcttgttcatttatcaggcaaaacgagtttgatgt

SEQ ID NO: 42 - DNA, 480 bp, Euphorbia heterophylla
acaggttgtgcattccacccagaaacgtcagcgtggttcattttcgtttctgggtggaatgcagactcttcctgacaggttgtgcaaagagcttgcaaaagacgagcttagacttgagtcaaaggttttgtctttgtcttataatcacgattctagatcggcgttagacaattggtctgtctcttttgcttctaagggcaacaaacgtatgcaagactcgtcatatgatgccgtcattatgacggcaccactttgcaacctcaaagaaatgaggatcacaaaaggcagaaatcacttcctgttggactttattcccgaggtaatttatatgccactgtcggtcattattacgacgttcaagaaggagaatgtcaagcaacccctcgaaggttttggagttcttgtaccttctaaggagcaacaaaatggtctaaaaacgcttggcacactgttttcgtctatgatgtttcctgaccgtgc

SEQ ID NO: 43 - DNA, 4067 bp, Euphorbia heterophylla
tttattgtgtaataattaaaggataatattactgtaaaataatttatattatttaatataataattttaatattattatttttccttaaaagaattataaatgagcttgtaatgttcatgaacaatccatgaataagccaattgttaaatagaccattcatgaatatgcattttgagctcgaattaaactcagcttatttacattgttgtacatgtgaaatcaagagaatgctcataaagtgagtattaaaccgaaacattttatatttcttaaaggtctgacacatgaattctgagaaatcaaatctgtaatattttgacaaatgaaataaatcgtaaaatacatatattcattttagtaaaatctctaaatttttaattctttcaatcttaacatcttcttcctcaaatccttgtaacaaatcacagcacaatattttagcattcaaattcatagaatataattaaccgttcaaatctaccaatcccacctccttacccacagcttctactccgagtccattcattaaccctcctctctttgttacaaattcttccatgtcttatttttactaaaatctatgctatctatgtttcctaaaattattccacctgctttcagttttaataaaacttcagatactttgaagaactccaacactccattaaatgagaccaagtttcgcaagtcgggctaccctttgttgggcccaagcgcaatttggacacctattttttactaagttcggcttaagcctcagcccgtcaaaatttaaagttttatgcgttgagctgggttttttacaattatccgagcctaatccgataaataataatttaattttttttatatattatatattgtactaaataattatttcaatatttatatttcaaagttatgggtgtgcatctggttaaaacctaatagaatcgaataaatcgaatatcaaatagagaaaccaaaccaaatacgaatcaaaatcgaattaaccaaatcaaaaataaattattccgtttggttaaaaaccgaaccaaaccaaatttttttaaaaaacaaacttaaattaaaaattttaactcttaaaatccaaaaataagtattacaatagttcaaatgacttagttttgacacataaatgaatgagggtgcattttggggtttgatgttaaaatgatctatatttgagcattattagtagaatattttaaatttttattatgatatttcaattcgattcggttattgtagttttttcaacactaaaactgaactgaaaattgaaatgtttaactttaataaataaaccgaaccgaattttcaaagtaaccgaaccaaattaataactcagtcttattcgattcggaaatgtagttaccaaaaccatttgcacacccatattttacactaatgaatttttaaacttaaatacaataaattgtataaattattaaaaatttcaaataaataatataatcatacgtaattttgtcaatttatttcttaaaatctataaaaaaaaaagttattaaaatactatctacagcctttggaaatgattccataagcctgatccgagcacggagttctaaaatacggattgaagcagacttggaatgatacttttgtcgaaagcccacaaagtctggcctgttcgattaacatgtcaaaacaatagaagaaaatatctttttattttcgtgtaaatgaatttaccagtaaggttgcgtttatcatttgtagccttcgtccaatcagattgacacgctatatttctccttgtcaattgaagataacacagcactatttccctattagttctgaggccgccactaaacggagtgcgcttgcctcttaccaccacctttcgccgccatggcctctatttccgacttgtctcttttccggccaacaccttctcttgttccatcattttccaaacgcaatttaaacaactctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattgattgtcatgtctaacaaattattgacgaaatttgcttgtaattggagattttggttgaattagctaatttgatcgtattgtaggtggatagtggtttgaaggatgacctagttttgggggatcctactgcgccacggtttgtattgtgggatgggcaattgaggccagttccttctaagccaagtgacttgccgttctttgatttgatgagcattggtggaaaactcagagctggttttggtgctcttggacttcggcctccacctccagtttgtcctctttaactttcttattgtaattgttctccgattgaaaatagtcccccgtgtgtaattttatctgctcgtaaccttacaattctgctgaaagtgacagggacgtgaggaatcagttgaagagtttgtgcgccgcaaccttggagatgaagttttcgagcgtttgattgagccattttgttcaggtaagttaagatatttggagcttgtagtgttcttattagttgacactgtatcatgtcaagttgtgttatcagacccattacaacatcttaccaatcatcacatgaatattgctgtatttcccatgtaaaattaaaccgatacaacatacctcgacttaaattgacgaatacaattcaatgtagtggtacttagttgacgtcccttttggttcgacgacctcttttaattatgatatgttgtgttatatctaaacactaaattatgaatttcattcaaaatctatgccattgttaatacaaatcattatcaaacttgaagtgaattccattattgaagtttatattgcatgctcaatctcatccatctgatatttgattcatttatttaagtagtcctttagcgtgcatatcgtgaatggttccttgagatgtgcttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatgatgtatgcttctcaaacttaaaatcgccctagttgattttgttgctaaattcggaagttttatttgtataatttgtatatcttgacaaggttgtccttaatgggagatgctatttttcatgtgcaggtgtttatgcaggtgatcctgcaaaactcagcatgaaagcagcattcggaaaagtttggatgctggaacaaaatggaggcagtatcattggtggcacttttaaagcaatccaggaaaggaataaaaatcccaagcctcctcgagacccgtatatttatctccttgctttgagaatatcttacatcttttgtttttgttgagtttcttgactctagtgccctgcaggcgtctaccaaaaccaaagggccaaacagtagggtcttttaggaagggactgactatgcttccagaggcaattgcatcaaggtaacatttccaccggaattaaaattttatgaactttagatggttgtaataattcttgacagtggctgaagtaattgactgattacctgcattggtgttgcagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctgtatgtttttc

SEQ ID NO: 44 - DNA, 2630 bp, Euphorbia heterophylla
tacactaataaatttttaaatttaaatacaataaattgtataatcatatataaatttatcaatttatttctttaaaatctataaaaaaaagttaataaaatactatctacagcccttggaaatgattccataaacctaatccgagtacggagttctaaaatacggattgaaccagacttggaataatacttttgtcgaaagcccagaaagtctgggtccgctcgattaacatgtcaaaacaatagaagaaaatatctttttattttcgtgtaaatgaatttaccagtaaggttgcgtttatcatttgtagccttcgtccaatcagattgacacgctatatttctccttgtcaattgaagataacacagcactatttccctattagttctgaggccgccactaaacggcggtgcgcttgcctcttaccaccacctttcgccgccatggcctctatttccgacttgtctcttttccggccaacaccttctcttgttccatcattttccaaacgcaatttaaacaactctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcactcgccactaagcaccggaatgttgctcccaatgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattgattgtcatgtctaacaaattattgacgaaatttgcttgtaattggagattttggttgaattagctaatttgatcgtattgtaggtggatagtggtttgaaggatgacctagttttgggggatcctactgcgccacggtttgtattgtgggatggacaattgaggccagttccttctaagccaagtgacttgccgttctttgatttgatgagcattggtggaaaactcagagctggttttggtgctcttggacttcggcctccacctccagtttgtcctctttaactttcttattgtaattgttctccgattgaaaatagttccccgtgtgtaattttatctgctcgaaaccttacaattctgctgaaagtgacagggacgtgaggaatcagttgaagagtttgtgcgccgcaaccttggagatgaagttttcgagcgtttgattgagccattttgttcaggtaagttaagatatttgtagcttgtagtgttcttattagttgacactgtatcatgtcaagttgtgttatcagacccaatacaacatcttactaatcatcacatgaatattgctgtatttcccatgtaaaattaaaccgatacaacatacctcgacttaaattgatgaatacaattcaatgtagtggtacttagttgacgtccctcttggttcgacgacctcttttaattatgatatgttgtgtttatctaaacactaatttatgaatttcattcaaaatctatgccattgttaatacaaatcattatcaaacttgaaatgaattccattattgaagtttatattgcatgctcaatctgatatttgattcatttatttaagtagtcctttagcgtgcatatcgtgaatggttccttgagatgtgcttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatgatgtatgcttctcaaacttaaaatcgccctagttgattttgttgctaaagtcggaagttttatttgtataatttgtatatcttgacaaggttgtccttaatgggagatgctatttttcatgtgcaggtgtttatgcaggtgatcctgcaaaactcagcatgaaagcagcattcggaaaagtttggatgctggaacaaaatggaggcagtatcattggtggcacttttaaagcaatccaggaaaggaataaaaatcccaagcctcctcgagacccgtatatttatctccttgctttgagaatatcttacatcttttgtttttgtttagtttcttgactctagtgccctgcaggcgtctaccaaaaccaaagggccaaacagtagggtcttttaggaagggactgactatgcttccagaggcaattgcatcaaggtaacatttccaccggaattgaattttatgaactttagatggttgtaataattcttgacagtggctgaagtaattgactgattacctgcattggtgttgcagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctgtatgtttttcataatca

SEQ ID NO: 45 - DNA, 1010 bp, Euphorbia heterophylla
agattagtgaatgatcacaacaaataccgtttgataagtccaattttttctttttttgcaagatttggttctattatagctggggcaattcagtcaaatttttcctcgaaaaaggataagagcaaggagacaaattcatcaagacataagaaacgtcagcgtggttcattttcgtttctgggtggaatgcaggtattagatgtaggatattacttatgaactctgaaatttgtatctaatatcacttttcttaaagcccctaaatgattttaatattaggattttctttttgtatctagctttattatttgctcgattttactcgttaaagctatgtttatttgttgagaagccttctagaggcgatacagattttcttagcttatgcaagtgattatcctatgaactatttatgttttcttttcccgaatctatttttctttgcagactcttcctgacaggttgtgcaaagagcttgctaaagacgagcttagacttgggtcaaaggttttgtctttgtcttataatcacgattctagatcggcgttagacaattggtctgtctcttttgcttctaagggcgacaaacgtatgcaaaactcgtcatatgatgctgtcattatgacggttagcaacttctttactgatgatataatgtttatcaattaatctttttgatatcgaaacgaaacaatttcattgtttactcagattcattatcacttctaaaatttcaggcaccactttgcaacctcaaagaaatgaggatcacaaaaggcagaaatcacttcccgttggactttattcccgaggtacccttcttgcaaatctattgacaagaatggatgtcaataattcaaccgaaaccatatgaactattgcaggtaatttatatgccactgtcggtcattattacggcgttcaaaaaggagaatgtcaggcaaccccttgaaggttttggagttctggtaccttctaaggagcaagaaaatggtctaaaaacgcttggt

SEQ ID NO: 46 - DNA, 855 bp, Euphorbia heterophylla
acttttttacatgttcagggggttatttgaaacatttgaaagttcaaggggtaactagccctttttgaacaagttcaggggttttcatgtattaggcctctatttaatattggatgctccaattggacacctgagctttatgttgtcataattagtagtagatatagctttcttttaattttcacgtgtttttttcgtgtaaatagaaagacagcgaacttgttgaagcagttgaccgtgatctgcgaaagatgctcataaatcccaatgcaaaggatccacttacacttggcgtaagagtgtggcctcaagccattccacagtttctgattggtcactacgatatcctagatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaacccagtatacttataaatagtatctgatgagatttaagcaagagttcaattatgctgcggctaagtactgtgagtttattgagtagtgggtaaaaatgttgctttaggtctgttgtatttgtaatagttgcttcacgtttttcattaaggatggtgtattctctagttatgcattcttgttcatttagcaggcaaaacgagtttgatgtgcattcagaatatgttggcagttgattgacactctaagcttacaggaagtatggaactgtatagcccatgagaatctaaaatctctaacactagccgttagtacaatggccggactatgcccaagtagttaactgttatagccagtgttttaaaaatcgg

SEQ ID NO: 47 - DNA, 121 bp, Euphorbia heterophylla
aaccgaaccgaattttcagagtaaccaaaccaaattaataactcagtctgattcgattcggaaatgcggttaccaaaaccatttgcacacccatattttacactaataaatttttaaattt

SEQ ID NO: 48 - DNA, 77 bp, Euphorbia heterophylla
ttttttcaacactaaaactgaattgaaaattgaaatgtttaactttaataaacaaaccgaaccgaattttcagagta

SEQ ID NO: 49 - DNA, 444 bp, Commelina diffusa
gctatatgaaacatcagaaggattgacttcagtacagactagaagtgttgttctgactgttccatcttatattgccagcaatctccttcgctctctttcaaatgacgcagctgatgctttgtcaaagttttactatcctccagttgctgctgtttccatttcatatccaaaggaagctattaggaacgaatgtttaatcgatggtgagcttaagggatttggccagttgcatccacgtagtcaaggagtagagacactcggaacaatatatagctcatcccttttcctggccgagctccccaagggagaatattgcttcttaactacattggaggtgctacaaatactggaattgtatcaaagaatgagagcgaactggtagaagcagttgatcgtgaccttagaaagatgctgataaagccaactgctgaggatcctcttctt

SEQ ID NO: 50 - DNA, 3043 bp, Commelina diffusa
aattttcttgtgttatgggggaaaaaatctatattgtcataaagagaaaaaaaaattgaatatacaaaccacaacaattagattgctttttccctactatatggggttagctatatgaatcttagtttgcattttttcttatctaaaaaccatttctttagatggccctagataagacagtcaccttttaggacttcgtgaagtgacttttttttttggttatataccatggttgcaagtctcagccaataccaatacgtatcatgtatcgagatcggtagctactgttataggatcgacatagtatcttggattgacatttgcttgttggctggctggccaattttggccagagaatggtaggagttggccggtacgaccgtaacggtgtcaatttcacttggtatcagccaatatcgatcattatgagctctgacaccgttgatattgtattgaaaattaaaatttctattttagaaagttaaatttttattagtttatttatttcttgttaactaatattatcaatattgatacgtatcagatttgaggaaacagatttgcagtcctggtctaaacctctaccctgtgtacgactaccgaaatctagtattgtaacttttctaacaggtgcatctactatctatagaacgtctacaaacacgtacaaactgctgtaaaggattttttcctaaacttgttattaatatgagtcacctatagttttccttgcacatacttgtttggagttgatctttcctagtgacacctaacttccacctcaacgttcttatctgtgctagacgcactgtttgggtatcttgcttcttaagagcccattattttcataaatcattgtagacctaataccaattttatacaatttacccttagatttaagagactctacaatcacataacattcatgaagtttcttgccattttaaccatcttgttttaatgctattaataatatcttctatattttctctattatcttgaataatggacacaagatacataagttttttatttctaaccaactatactccatctaacataacaaattaatttgttcttgtcctactattaatatttcgtttcatatattttgttttaactctacttcatttaaaactaaaattacatgctggaactgaggttctaatcttaagttaacaccttctgctctctcatcatataaaacttctcaacaaaaaatttatgccaaggaatatcattctagatatgccaaagtcaatagaagatatgaatttaaagaaccttggtggactcctattgtgataggagatctattgaactttcttacttatttttaattatgtcttatatctactagaaaccatttgcttttctaagatctaccaaagaacatccataggtattctatcatatgcattttctgagtcaataagaaccatatacatgtctttgttcctatttctaagcgtttgtactaattgccttgataaactgatagtggtaggtataaatccaaaatgattattagaaatattagtttcacatcttagtcgttgttctgtcactattcttttcctactttcatcttcctaagagcatcttttacttcacaagtcctgatgttttgaatataagtagttctttttttttttaattagtggaatttacctgtaaaactatgtctagcaaggctctctccaagtgtaactttataatcctcataaatcctctgatcaccatttctagtgagaaaaggaaatcaatttggcccctactagaactatccttaaaagtaattaaatgacagtctctctttccatatagaataatgattaccaccgtattgtacgataaagcagattctaaaattttgacctttacattattcatctccccatacccataatcaccacaagtaaacttaattttcctactatcttttgcctacgtgtcatggatgagtaccaggggaggaggagaggacaggggaaaaaggaacaaaatggaatcaaaataaaataaaatgctcatgccaacaataatgtggctaaaatcggacggaaaactaccgatggaagtttttgcagcatttaatgaaatgttaagtgtatttgctatttcaaaaaaactcaattattttttattgttttggcaaaggtttagattttatctgcatttaactcttataaaacattatgaaatgatatttgttatcgactttcttgcactttcatgtgctaagcgtgtcacaactgctgaatgctactatgcaggaacaatatatagctcatccctttttcctggccgagctccccaagggagaatattgcttcttaactacattggaggtgctacaaatactggaattgtatcaaaggtgttggaacttgaccatttttcagtttttgtgaagttgcaaaaagttatatcctctacgaaaacatatgcagcttaggctatccataatatataatccatttttaattagtgaaaacatatttcctaggaaacctcaattaaaatgtcatccattatgtctacaattgatactttattttgtttgctcttcttttccagacagtttttctagcatttacaccatgttgccactaggaatattgagtttggactggtttttccattcattggctaaaattttgtctatttcatttaaacatggagaggatgttgcaaacaccttctagatgtttgaattatcaaatcgttcataaagattttaagtcccaactaatatatgatgctgatttttcaagttttttttatgtgcagaatgagagcgaactggtagaagcagttgatcgtgaccttagaaagatgctgataaagccaactgctgaggatcctcttcttgttggtgtaagagtatggccacaagctataccccagttcctggttggtcatcttgaccatctcgaggcagctaatgaagccctcaggaaaggaggttttggtggattttttcttggtggcaactatgtagctggtgtggcgttaggtagatgtgtggaaggtgcatatg

SEQ ID NO: 51 - DNA, 1559 bp, Commelina diffusa
ccatgctctaatagcttgtccgtcgtaatcttgggaatgaggtttttgaacgattgattgagccattctgttcaggtgcgcacaattcaattttcgctatgataagcaaaaaggtttttcacatgataattacctttgtttttttcttttggtgattaacatgcttttgtttgtaatgtcatatatatactatgttttacctagatatttgttttgaatttttttttcttctggatttttagttttctgcgttctttactccaaattgaatcagtttgtcataactgttatggcaattgttttgatcatgtttttaaaggagtctccctgttttatcatctagcttaggagtaccaaaatgagcatttatgttctctagaagttataggataagaaagacaggtgagaccttctggactgatttcacctaaaaaaatgctaaatctgcaggggtatatgctggagatcctacaaaacttagtatgaaggcagcttttggtaaagtatggaagttagaacagactggtggaagtattattgggggcactattaagacaatccaagatcaaaagaaaaatcccaaacctcctagagatccgtaagaatttcatgaaccaaattgggtttccatactacctgattgaaagtaatgaagtatccttgagttaattgttgctatttatcagacgcctaccaacaccaaaaggacaaacagttgcatcttttaggaaagggcttaacatgctacctgcagcaatttcttccaggtctttgttttttttcattctttgtaataccctgtaactatctgcaggcttttacaaactggttatactttttttttactttaccaagttggttagttagtagttatatttatgtgttcatactgaagatgagcaacttctgttttttatcataattatatttatatatttcttttgttatctatcaaggattatccttcagatctaacagttcacaaacttcactagcttgtatcttggaacatattttctttactttaatattttcattgacttgtatttcgtggaaaaacagactgggtagcaaagtgaaactatcatggaaacttgtgagcatcaggaagctggagagccaggaatatttattgctatatgaaacatcagaaggattgacttcagtacagactagaagtgttgttctgactgttccatcttatattgccagcaatctccttcgctctctttcagtaagcttatgccccactttaagcttctacagtccctttgaatatgtttatggaattctgttataaagaccttctcggttgctttttctgtagttaatttatgtggatggagaatctttctagaaattgttgacatgatactatatatggtatctatattgtgtgacatgttattgttgaccaatatatgctgttttcttgagttatctattccattgctctggaaatttctagatgttttatcatatcttacctatgttattttactgtcttaccatgacatatatatattttaattgtttattatgattaaagatatatatat

SEQ ID NO: 52 - DNA, 589 bp, Commelina diffusa
ttatgattaaagatatatatatccaattagtttacttccacattgcataatgtaccttgatatatatttcctactagcattttttccttaaaattacgatttttgtatgattatcagattaacaacactagcggcctcttttatattgatcctagtggaaggaggatattcctcctaatttgttgtactaagacatcggctacatttttttttttgcttatggagacatctatattaatatttgtggttcacatgattcttgttgcttaaagattatttaatggatggtggttgcagaatgacgcagctgatgctttgtcaaagttttactatcctccagttgctgctgtttccatttcatatccaaaggaagctattaggaacgaatgtttaatcgatggtgagcttaagggatttggccagttgcatccacgtagtcaaggagtagagacactcggtactgttctgtcttgtttatggccccacactactcaccccaaatataatataggttctatatgtatatgctctctggatttccatttgcaataacagaaatcatgcctagcaaataattatatagtcatga

SEQ ID NO: 53 - DNA, 876 bp, Digitaria sanguinalis
gacatcctgcgtccactttcaagtgatgctgcagatgccctttcaagattctattatccaccagttggtgctgtgactatttcatatccaaaggaagcaattagaaaggaatgcttgattgatggggagctccagggttttggccagttgcatccacgtagtcaaggagttgagacattaggaacaatatacagctcatcactcttcccaaatcgtgctcctgctggaagggtattacttctaaactatataggaggtgctacaaacactgggattgtctccaagagtgaaagtgagctggtagaagcagttgaccgtgaccttaggaaaatgctcatcaaccctagagcagtggaccctttagtccttggtgtccgagtgtggccacaagccatacctcagttcctggtaggacatcttgatcttctggaggttgcaaaatctgccttgggccgaggtggctatgatgggctcttcctaggagggaattatgtagcaggagttgccctgggccgatgcgtggagggtgcctatgaaagcgcctcgcaaatatctgacttcttgaccaagtatgcctacaagtgatgaaagaagtcgagctgctcgttgttttgcatagatgaggtgagaccaggagtggcacaaagtttacaaggattttttttttcatcttatttcgtaaattgtacttctgatctttttccctgttagtaattagttagactgtaggactctaagacatgctctgttcgccatcctagaaaggaagttttcttttaggttcatcaacgagatcatccatgcagactcgtgtagcgttttcctgtaaacactagttccaggaaatttaaatactctcttgcaagagcaaaaaaa

SEQ ID NO: 54 - DNA, 518 bp, Digitaria sanguinalis
acctaatgccatctcaaaaagcttgggtagcagagtgaaattatcatggaagctaataaatatctcaaagttggagaatagaggttataatttgacttacgaaacaccaaatggatttgcaagtctgcaaactaaaactgttgtcatgactgttccttcctacgtggcgagtgacttgttgcgtcctctttcgtcggaagcagctgaggctttgtccaaattttattaccctccagttgcagctgtatctgtttcctatccaaaagaggcgattcgtgctgaccgtttgatcgatggtcaacttaagggttttggtcaattacatccaagaagtcaaggcgttgagactttaggtaccatctatagttcatcccttttccctaaccgggcgccacctggaagggttctcctcctcaactacattggaggggctacaaatcctggtattttgtcaaagacagagagtgaacttgtggaagcagttgaccgtgatctaaggaagatgctcataaacccta

SEQ ID NO: 55 - DNA, 387 bp, Digitaria sanguinalis
tggaggattctttcaacgtcattttgggaaggaggttgttgagtatctcattgatccagttgttgcgggaacaagcggtggagatcctgaatcactttcaatgcgttatgcgtttcctgagttatgggatttagagagaaggttcggttcaatcatttctggggcatttctgtcaatgttatcttccagaggtgggaaaaggaaaccttctggaaacagcaaacgtaggcgtggttctttttcttttttgggtgggatgcagacgctcactgatgcactatgcaaagagattggaccccatgaatttaatctccaatcaaaggttcttgaaatgtcctacagctgcgatgataacgtggttggtaattggtcaatttattgtgctcc

SEQ ID NO: 56 - DNA, 2697 bp, Digitaria sanguinalis
cttgcgtctcacaaaaggcgcgagctggccggcccgctacttttgtgctttgtcttgtctccttcaggcttcagcaatggacaaacatccccctcaagtaaagcttaatagaaatcgattttgatgaacgaataaccatcattaacggcatcatggccatcgcttcgatgggatcagttgcttgcagagccggccaaagtgggcacgtgagagccacgaggatacgcgagatgacgacgaccatggaggtggtttcgaactttcgatcgccgatttttattgcgtcagtttcacagccagagatgcttggcctagtacggctgacgatgagcgtttgtttagctcatctgaaggaatgtgttttgcctgttgccaccaagattagcgtccttttcttttatcgaattcgggtcaccatttccactattaatcaaagatatagtttctatattttttctcattaatccacagtaccttttatttcagtagttattattgcatccatacttcaccagtacggcaccctttgcaatctctgcctacactccattacctcgaagaatagtgcactacagatgcaataaacacccacctcaccgactgctcgtaggtgcaccagtacactacatttgctgctgcatgctggtcgccatcatccttcctgcctgcaggaagcagcagggtgtctgggatctgcatcatgccgggcgcacaagaggaacagacgtgccaataaaagggctagcaacgcaacgaggggagggcccctttttttcgtgttacctcccgtcctgtgcatgagttgtcgtgtgtaacagacgtgcttggtgataaagcgtaggtgaagaagtggcctcccctgtgtcccctcccttctcaggaacgtttcgtcatcttttcactgaaaacgggcgcgtgctaactgccgcatctgtgagttgaatggttgattggagagaaattaggtgtgcaatcaccacttgggcggcaatcgtgtgcacttacttttggttgggtgtcagatcaacaacaggggtttcttggggaaatgtttccaaatgtacttctcaaaattacttctagtgtacacatgttgaatttcagttcaaatttatttacaagaataataaacaaagaagaaaattggcaaacaacattcataaaaaatggaatgaaaagagaaatgcatccttcttttgaagataaatagtcaaatgccatgtttgtttcgttcacaaacagaaaaatgatttcatgattgcaccgcaagagtggatgaatatatataggtctacagttgaacaccaatttggaagaaaaattcatgaggcagaagtaaaatcgattatttccttgagcttccgcattgcatctcccaaaagaaaaccattaaatactactagcaagttctagtacagtccctactaattaaacatcagcataattatccttcttatactcactcgggttttttcttatatgtcgtattagtttcatcttaagtcaaacttgtcaaaatttgaccaagtttatacaaaagtataacaataactatactaccaaacttatatggtatcacaatatatttcattagtagggactgtctcgccggtcggggaaattaaacgccccccgatccgtcaccgtgacctgccctcctccccgcccgggcagatcgggccatcgcctccatcggggcacggctaggtacctgaaaacgatcgagcaaagcggccggttcgtttcgttcgtagcgagaggcatttgctgccagttcccggcgcgggacacgcgcgcgcgaaatggcggtgtcgagagggagggaggcgtcgctttcggcgggcgggggcgtgttccctggctgtagcccggcggcgcggcaggcctcgcgcgggtgtcaataccggcccggcggattaggtccccgtctttatgaccggcgcgcgcgcacccttgcggtgcccgtgcgttgacgacgctgccaccgcacgtcccccttcttcattccatggcagggacgacgacgctagctatagctgcacgtacgcggtcgatcgagtggctatggcttggtctctactgcacgccatgccgcccggcctcccaccacaataactcgtgtgccggcccggcacggcgcgggccgtggtggaactgatcgcgtcgcgcattgatcatcatgcgtgggggcgtcggggcgacggctcgagcgtgcgcacatgattgtgcgtgtcaggatcccagacgctagctacagcttgctgctggtccatccagtgccctacgtggacgccgatcgctgtgtgttggtgtgtggggtgatgatgatggcggatggatggagtcatggaggcactgcggggctcacaggagattttggtgggtggtggacgcatccgtcgcgtcgcccccggcgctcgagtgcaccccgtaccaacccaacacgtccgctgtcgtggagacgccggagggcgcatgaaatcattgttaattttctcttgtgtgttttttttaaaaaaattataataacaaaagatgcatgctcccttcttctttgattaactaatcgatcagctagctaactcacacattgtccttcctgcaagtagcgcatgtatatttatgctcaactatatgggtatatactttttttaaaaaaaacataatcaactatatatatgggttatatgtgggcga

SEQ ID NO: 57 - DNA, 1089 bp, Digitaria sanguinalis
taggtatttctttcaactgagtcttaagctacaacatctacagattattgtttttcttttgtggtgtgatttttcattctagtatgtattatgtcttcttttgttgaatccaagatatgaatcaaaatagtggtggtatgcttttgtaggaacaatatacagctcatcactcttcccaaatcgtgctcctgctggaagggtgttacttctaaactatataggaggtgctacaaacactggaattgtttccaaggttagtaattctctgtcgaacttattgccttgagttttgtgttcatgatgttttgactgtaaaaagaaaattggcattctttaataatcaacgtaagcagtattttaaaaagaaagttggcattttaataatcaatatcaacttgtaactagattgcttattattggctattattatttaggtgggacccgcagactatttaggtgtggaacccatgtgggacccgcatactatttaggcgggacccacgcatattcagacacactatttagagtggaacctacaataatgttaagcgtctacgttatttaaaaaattattgataattgttttcattctttgcagtataaaatatatttatttttttctatgtataaaaataatctctaactttgtatactacattcgtttgtgatagttctaatactttttgtactttgctttcatttcataaatttgaaaaataagattgaattatacattcgttacaaaatgtatcttttttctattaaaaattaaaaattagtgtaacataacacgtcactccattagctatttctactaccacttatatagtgcttaaatgattattatgattaaaaaatttgtctaaatttaatattgcattgagtatagtaagataacaaatttgtattacatcattattttagtttaacatcttctatatagacgcacatcgctcgtcaacccaactagtattcctaatgatgccatctcaattgcagagtgaaagtgagctggtagaagcagttgatcgtgacctcaggaaaatgctcatcgaccctagagcagtggaccctttagtccttggtgtc

SEQ ID NO: 58 - DNA, 1518 bp, Kochia scoparia
atacactgctctacaatctcaacctcaactccaacctcaagttcaaacccaggaacacttggcgaaggaggattattggattgtgtgatcgtgggaggtggtattagtgggctctgcattgcacaagcactttctacaaagtactcttctctttctacaaatttcattgttaccgaggcgaaagatcgagttggtggcaacattaccaccaaggaggatgatggctatatctgggaagaaggacccaacagttttcagccgtctgatgcagttctcaccatggctgttgattgtgggttgaaagatgaattggtgtttggtgaccccaaagcacctcgatttgtgctgtggaatgggaaattaaggcgggtaccttctaagctcacagatctccctttctttgatcttatgagctttcctggcaagattagagctggccttggcgctcttggatttcgtccttctccaccaggtcgtgaagaatctgttgaggattttgttcgtcgaaatcttggcgatgaggtctttgaacgtttgattgaacctttttgttcaggtgtgtatgctggtgatcctgccaagttaagcatgaaagctgcttttggcagagtgtgggttttggagcagatgggtggtaatatcattggtggcgctctcaaaactatccaggaaaagaagaataagcctaagccgcctcgagatccgcgccttccgaagccaaagggtcagacagttggatcctttaggaaaggactcattatgttgccgaacgccatttctgctaggcttggaagtaaagtgaaactttcttggactctagctagtatttctaagacacacaatggggaatataatttgatttatgatacaccagatggaccggtttccgtaaggactaaaagtatcgtgatgactattccatcatatgttgcaagtagtctgcttcgtccattctcagatgctgctgcagattccctttcaaaatttcactatccacctgttgcagcagtgtcactgtcttatcctgaagaagcgattagacctgagtgcttgattgatggtaaacttcaaggattcgggcaactgcatccccgcagtcagggtgtggaaaccttgggatcaatttatagttcatctcttttccctggtcgagcaccacctggtaggaccatgatcttgagcttcattggaggtgctactaatcctggcatagtagacaagacgcaagatgaacttgctaagactgttgacaaggacctgagaagaattcttataaatccaagtgcaaaagatcctcgtgttctaggcgtgaaagtatggcctcaagcaataccccaatttttgataggccactttgatctgcttgatgctgcaaaagctgctttgactgatgctgggtgtaaaggattgtttcttggaggaaactatgtatcaggtgttgccttggggcggtgtatagagggtgcttatgaatctgcagccgaggtagttgatttcctctcccagtattcagacaaa

SEQ ID NO: 59 - DNA, 963 bp, Kochia scoparia
atacactgctctacaatctcaacctcaactccaacctcaagttcaaacccaggaacacttggcgaaggaggattattggattgtgtgatcgtgggaggtggtattagtgggctctgcattgcacaagcactttctacaaagtactcttctctttctacaaatttcattgttaccgaggcgaaagatcgagttggtggcaacattaccaccaaggaggatgatggctatatctgggaagaaggacccaacagttttcagccgtctgatgcagttctcaccatggctgttgattgtgggttgaaagatgaattggtgtttggtgaccccaaagcacctcgatttgtgctgtggaatgggaaattaaggcgggtaccttctaagctcacagatctccctttctttgatcttatgagctttcctggcaagattagagctggccttggcgctcttggatttcgtccttctccaccaggtcgtgaagaatctgttgaggattttgttcgtcgaaatcttggcgatgaggtctttgaacgtttgattgaacctttttgttcaggtgtgtatgctggtgatcctgccaagttaagcatgaaagctgcttttggcagagtgtgggttttggagcagatgggtggtaatatcattggtggcgctctcaaaactatccaggaaaagaagaataagcctaagccgcctcgagatccgcgccttccgaagccaaagggtcagacagttggatcctttaggaaaggactcattatgttgccgaacgccatttctgctaggcttggaagtaaagtgaaactttcttggactctagctagtatttctaagacacacaatggggaatataatttgatttatgatacaccagatggaccggtttccgtaaggactaaaagtatcgtgatgactattccatcatatgttgcaagtagtctgcttcgtccattctcagtgagt

SEQ ID NO: 60 - DNA, 564 bp, Kochia scoparia
caggatgctgctgcagattccctttcaaaatttcactatccacctgttgcagcagtgtcactgtcttatcctgaagaagcgattagacctgagtgcttgattgatggtaaacttcaaggattcgggcaactgcatccccgcagtcagggtgtggaaaccttgggatcaatttatagttcatctcttttccctggtcgagcaccacctggtaggaccatgatcttgagcttcattggaggtgctactaatcctggcatagtagacaagacgcaagatgaacttgctaagactgttgacaaggacctgagaagaattcttataaatccaagtgcaaaagatcctcgtgttctaggcgtgaaagtatggcctcaagcaataccccaatttttgataggccactttgatctgcttgatgctgcaaaagctgctttgactgatgctgggtgtaaaggattgtttcttggaggaaactatgtatcaggtgttgccttggggcggtgtatagagggtgcttatgaatctgcagccgaggtagttgatttcctctcccagtattcagacaaa

SEQ ID NO: 61 - DNA, 516 bp, Kochia scoparia
gtaacttgcctacccctctcagttataattactacattcaagaaggttaatgtgaaaagacctcttgagggctttggagttcttgtcccctctgttgagcagaaaaatgggttgaagactcttggtacactattttcctccatcatgtttcctgatcgtgctccctctgatgtgtatctctatacaacctttgttggtggaagcaggaatagtgaacttgcaaaagcttcaacggatgagctgaagcaaatagtttcttctgaccttgagaagctattgggcactgagggtgaacctacctctgtgaatcatttctattggagcaaggcattccctctttatgggcgcaactatgactcagtactcaaagcaatcgagcagatggaaagagatcttcgtggacttttttatgcaggcaaccataaagatggactttccgtgggaaaagctataacatcgggacacaaagctgcggagcttgtaatgttgtatctcaactcttcattagatgcaaag

SEQ ID NO: 62 - DNA, 1185 bp, Lolium multiflorum
gagcgcctcatcgagccttctgctcaggtgtgtatgcgggtgacccttcaaagctcagtatgagggctgcgtttgggaaggtatggagactggaggagaatggaggcagtattattggtggaaccatcaaggcaattcaggatagaggcaagaaccccaaaccgccgagggatccccgacttccgacaccaaaggggcagacggtggcatctttcaggaagggtctagccatgctcccaaatgctatcgcttctaggttgggtagtaaagtcaaactctcgtggaagcttacgggcattacaaagtcggacaaccagggatatgtgttagcgtatgaaacaccggaaggagttgtttcagtgcaggctaaaagtgttatcatgaccattccgtcatatattgctagtgaaatcttgcgcccactttcgagtgatgcagcagatggtctctcaaaattttattatccaccggttgctgctgtaactgtttcatatccaacagaagctattagaaagaatgcttaattgatggggagctccagggtttcggccagttgcatccacgtagccaaggagttgagactttagggacaatatatagctcttctctctttccgaatcgtgctcctgctggaagagtgttacttctgaactatatcgggggtgctacaaatacagggatcgtctccaagactgagagtgacttggtggaagcagttgatcgtgacctcagaaaaatgttgataaatcctacagcaccagaccctttagccttaggcgtccgagtgtggccacaagccattccacagtttttgattgggcaccttgatcgccttgatgcggcaaaatctgccttggccagaggcggctgcagtgggttgtttctaggaggaaactatgtagcaggagttgccttgggccgatgcatcgagggtgcgtacgagagtgcctcagaagtatctgacttcttgaccaagtatgcctacaagtgatgaaagaagtgtaattcatcatcttgctgcatatttgaggtgcggccagaattagtaataattcggaaaatcttgtaatcttctctacttatacctcctatcgttttcctaatcgcaatttagttagaagttaggtttgtagaagaaattttactagttgttcagtataattctttcagattttggtgatgcaa

SEQ ID NO: 63 - DNA, 258 bp, Lolium multiflorum
ttgaaacaacttgtgacctctgaccttagaaagctcttgggtgtagaggggcagccaacttttgtgagacatatacattggaaaaatgcttttcctctgtatggccatgattatgatttggcattggaagctataggaaagatggagaatgatcttccagggttcttctatgcaggaaataacaaggatggcttggctgttggaaatgttatagcttcaggaagtaaaactgctgatctggtgatctcgtatcttgag

SEQ ID NO: 64 - DNA, 201 bp, Lolium multiflorum
ttgatatttattatgcaggtggattatctgccgttatccctcatggtaacagcttttaagaaggaagatgtcaaaagacccctggaaggatttggggtgttggtaccctataaggaacagcaaaaacatggtctgaaaacccttggaaccctcttctcctctatgatgttcccagatcgagctcctaatgaccaacactta

SEQ ID NO: 65 - DNA, 150 bp, Lolium multiflorum
aatcctgccttattggtatttattatgcaggtggattatctgccgttatccctcatggtaacagcttttaagaaggaagatgtcaaaagacccctggaaggatttggggtgttggtaccctataaggaacagcaaaaacatggtctgaaa

SEQ ID NO: 66 - DNA, 144 bp, Lolium multiflorum
agtgttgggagcttctttgaacgccattttggaaaggaagttgtcgactatcttattgatccatttgtagctggaacaagtgcaggagatcctgagtcattatctatccgtcatgcatttccagcgttatggaatttagaaaag

SEQ ID NO: 67 - DNA, 114 bp, Lolium multiflorum
ataggaaccctcttctcctctatgatgttcccagatcgagctcctaatgaccaacacttatttacaacattcgttgggggaagccacaatagggatctcgctggagctccaacg

SEQ ID NO: 68 - DNA, 108 bp, Lolium multiflorum
agggtggccatcatcggcgccggcgtgagcggcctggcggcgtgcaagcacctgctggagcgcggctgccggcccgtcgtcttcgaggcggacacgctccttggcggt

SEQ ID NO: 69 - DNA, 3037 bp, Lolium multiflorum
ctcgacgcgaacgcgggatctctttcgcgtcaggcgtgaaatagggccggatttccatatacaactactaaccgagaaccccgcccactggaatgcgattcccagcccatcgacctatccaattccaattccagtgggccatgaaaaccgcaaaccaaccaaccaatacagccgcagccgcatcccgtcatccactccgcactgccatctcccccgcccgagcgacggaaatggtcggcgcaaccatggccaccgctaccgtcacggcggcgctaccgctccgcctccgggtccccgcgcgcccccgacgcggacagacgcgctgcgcggtcgcgagcgatgccaccgaggcgccggccgtgcccagcgcacggctgtccgcggattgcgtcatcgtgggcggcggcatcagcggcctctgcaccgcacaggcgctggccaccaagtacggcgtcaccgacttgctcgtcacggaggcccgcgctcgcgcaggcggcaacatcaccaccgtcgagcgccccgacgaggggtacctctgggaggagggccccaacagcttccagccctccgaccccgtcctcaccatggccgtacgcaccatgctcgctttctccttcttttccggattcttcgggacgtaggcgtacagaatacagatacgatcgctgaatggattggttgcgcaggtagacagcgggctcaaggatgacttggtgttcggggaccccaatgcgccgcgcttcgtgctgtggcaggggaagctgaggccggtgccgtccaagcctggcgacctgcctttcttcgacctcatgagtattcctgggaagctcagggccggccttggcgcgctcggcattcgtccgcctcctccagtttgtgctctgcccgtgctctctattctttagtgaattttgattgtcaaagatggggctgagcgttcccggcgaaggtttcaggggcgtgaggagtcggtggaggagtttgtgcgccgcaacctcggcgcggaggtctttgagcgcctcatcgagcctttctgctcaggtaatgtgcagtagtatatgtctgttctgttctgctctgcttcttgcattgatcccgataataagaatataacatttcgatatcaacgttaggtgtgtatgcgggtgacccttcaaagctcagtatgcgggctgcatttgggaaggtatggagactggaggagaatggaggcagtattattggtggaaccatcaaggcaattcaggatagaggcaagaaccccaaaccaccgagggatccgtaagtggagactctacttttctatttagtcagttaactcactgttccattagactcgtattaatctgtttcaccacttttagccgacttccgacaccaaaggggcagacggtggcatctttcaggaagggtctagccatgctcccaaatgctatcgcttctaggtttgttttcatcacttgtgcacatacctaagttatgctatcagtatacgtggtgctgtatattgttcagatagaggggacagatctgttggtagacctactgtttgctgaactcaataccatatgaatatcattgcatcagcacccaaagtacctgtggctcgattattatatcagccattctcgcattgttgatactaatgcatctgtgttaatctttttcatcttgcttttttggttgggacctgtactatataggaaattccacgagggatgagttatagagcatgtgtgtgtatgtccatgccccttgtactcggagatgatcatgaattatagtaataatttcatgcttggtcttaagacgtaaccctgtcatgttttgcattccttcatttccaggttgggtagtaaagtcaaactctcgtggaagcttacgggcattacaaagtcggacaaccagggatatgtgttagcgtatgaaacaccggaaggagttgtttcagtgcaggctaaaagtgttatcatgaccattccgtcatatattgctagtgaaatcttgcgcccactttcggtaagttcatgtttgcaaaattaattggtgtactactaatgttagtgttaggttcctgtagttctccatactcctgtgcagtggcggacccaggattttggcaaagggtatgccacacaaaaaaattggcctgccttgataacgattttttcttagaatatgaagtagaagtgatgattatgaaatatgattgaaaaaatcaaataaaagtgttcttgcattataatcaaaatattaaattgcttaacacatgcacggtttgcgaggtgtcctattttttaaactaatttctcaccgtaccatctgaccctaaatttctgaagtatttgaccacggaataatcgtttcagcaacactacaagataacgttagatcgtactaaataaacaaagaaatatgctgaagaaagctacaacggagcatataaaaattagtcacaatagctaaatggtttcttaattaatcaccatagctaatcatccattacgaaagtacctggacgcatgcatggtgcatggccatgtctctaggctagtttagcaattaaccggatggtcaagtgagtaccaaaaactaataaagcatgtgtccctgtacgatgcatgctcgcaggctacatgcaccggcttgattaaaatggccagctgattacaggcggttcatatggctgggccgctaggtatgccatggcatatgcggcataccctgtaggtccgcactgctcctgtggtaaccatgaaatagcacgctagtacactattccttaatagagttgctaatcaataattgaccgcattacgatactggttgcctgtaatcttagtccaaacacatgattgagcatttttgttgagagattaattgattaatgtggttaaactgttcactgatgcataggttggactatttcttcaccaatcaactctatgtttcaaataattgaaatatacatcaatagattcagaaaactgtatcttgttttgacaaagtgacgcaagacaccaatatgccttatgat

SEQ ID NO: 70 - DNA, 795 bp, Lolium multiflorum
ggttttggtattattctactaataattcgtggcatttttatgtagggacaatatatagctcttctctctttccaaatcgtgctcctgctggaagagtgttacttctgaactatatcggtggtgctacaaatacagggatcgtctccaaggttctctcgacctgctggatactcatgtcattttcttattgcgtgataccaggttacagtattcagttagtgttggtcacctattcatttatgattaatataaataactggactgcatttttcacccccagctgcaattgtgaatacaaatagattaaatggtctgcttagatgctacattcaatctcaatagtattgttagattttttttttggctggccatatttatactgatcccattttgtttgcagactgagagtgacttggtggaagcagttgatcgtgacctcagaaaaatgttgataaatcctacagcaccagaccctttagccttaggtgtccgagtgtggccacaagccattccacagtttttgattgggcaccttgatcgccttgatgcggcaaaatctgccttggccagaggcggctgcagtgggttgttcctaggaggaaactatgtagcaggagttgccttgggccgatgcatcgagggtgcgtacgagagtgcctcagaagtatctgacttcttgaccaagtatgcctacaagtgatgaaagaagtgtaattcatcatcttgctgcatatttgaggtgcggccagaatcagtaataattcggaaaatcttgtaatcttctctacttatacc

SEQ ID NO: 71 - DNA, 381 bp, Lolium multiflorum
tcaggggcgtgaggagtcggtggaggaatttgtgcgccgcaacctgggtgcggaggtctttgagcgcctcatcgagcctttctgctcaggtagtgtgcagtagtatctgtctgttctgttctgctctgcttcctgcattgattccgataataagaatataacatttcgatatcaacgttaggtgtgtatgcgggtgacccttcaaagctcagtatgcgggctgcgtttgggaaggtatggagactggaggagaatggaggcagtattattggtggaaccatcaaggcaattcaggatagaggcaagaaccccaaaccgccgagggatccgtaagtggagactgcaattttctatttagtcagttaactgttccattagact

SEQ ID NO: 72 - DNA, 200 bp, Amaranthus albus
ggaatccttgatttgaagataggataaccagagagagtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagc

SEQ ID NO: 73 - DNA, 200 bp, Amaranthus albus
gcttgagcttgtggaacaatggatatatgataattttcgtggtcttctgaagaagatgggggagtgggttcgtgtatgagcaaaaaagcggaacgagatgtcggagtgcggcggacattgtagaatgctgctcgataacgccatcgcactcatctctctcgcactctctctggttatcctatcttcaaatcaaggattcc

SEQ ID NO: 74 - DNA, 200 bp, Amaranthus albus
tatccattgttccacaagctcaagctcaactgccaattaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggag

SEQ ID NO: 75 - DNA, 200 bp, Amaranthus albus
ctccaacacgatgtttagcttcagtgacaatgaaattgagattggattgaatgtgtttggtagaaagagcctgagcaatgcaaagtccactgataccagctccaacaattacacaatctaatactttttctccttctccttggctcgtaatcgtgttctggtaattggcagttgagcttgagcttgtggaacaatggata

SEQ ID NO: 76 - DNA, 200 bp, Amaranthus albus
actgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgt

SEQ ID NO: 77 - DNA, 200 bp, Amaranthus albus
acaggccttaatttaccattccacagcacgaaacgaggggcattaggatctcccaagaccaaatcgtctttcaatccactgtcaaccgccatagtaagcacaggatcggagggttggaaactattaggaccctcttcccagatatagccatcggactccatggtagtgatattacctccaacacgatgtttagcttcagt

SEQ ID NO: 78 - DNA, 200 bp, Amaranthus albus
tgtggaatggtaaattaaggcctgttccttccaaacctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgatt

SEQ ID NO: 79 - DNA, 200 bp, Amaranthus albus
aatcaagcgttcgaagacctcatcgccgagattacggcgcacaaattcttcaacggattcctcataagaagaaggaggaggaggaggacgaagaccaagtgcaccaagaccagccctaatcttaccaggaaagctcatgagatcaaaaaagggaaggtccgtaggtttggaaggaacaggccttaatttaccattccaca

SEQ ID NO: 80 - DNA, 200 bp, Amaranthus albus
cgatgaggtcttcgaacgcttgattgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttccta

SEQ ID NO: 81 - DNA, 200 bp, Amaranthus albus
taggaaggcgggggtctcgagggggtggaggattattcttcctttcctgaatagttttgagtgtaccggcgatgatactaccacccttttgctctaaggtccagacctttccaaatgcagctttcatactcaactttgcaggatcaccagcatagacaccagaacaaaagggttcaatcaagcgttcgaagacctcatcg

SEQ ID NO: 82 - DNA, 200 bp, Amaranthus albus
ccccctcgagacccccgccttcctaaacctaagggccagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgt

SEQ ID NO: 83 - DNA, 200 bp, Amaranthus albus
acagaaaccggtccatcgggtgtttgatatgtgagattgtattcaccattgagcgacttatcaatattagaaagtgtccacgatagtttgactttactgccaagcctagcagcaatggcggtaggtaacataatgagtcctttcctaaaggatccaacagtctggcccttaggtttaggaaggcgggggtctcgaggggg

SEQ ID NO: 84 - DNA, 200 bp, Amaranthus albus
taggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgc

SEQ ID NO: 85 - DNA, 200 bp, Amaranthus albus
gcagatcaaagtgaccaactaaaaattgggggattgcctttggccatactctcactcccagaacacggctgcctttcgcatttggatttatcagaatttttctgagatccttatcaactgtctccgcaagttcatcttcactcttttgtaatatgccaagatttgtagcacctccaatgtagctcaagatcaaggtccta

SEQ ID NO: 86 - DNA, 200 bp, Amaranthus albus
tttttagttggtcactttgatctgctagatgctgcaaaagctgctttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcagtagggctccagca

SEQ ID NO: 87 - DNA, 200 bp, Amaranthus albus
tgctggagccctactgactacttgtctttgtactgtgagaggaaatccactacctgagatgcagagtcataagcaccctctatacacctccccaaggcaacacctgatacataattaccaccaagaaacaacccctttagcccagcatttgccaaagcagcttttgcagcatctagcagatcaaagtgaccaactaaaaa

SEQ ID NO: 88 - DNA, 200 bp, Amaranthus graecizans
gtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagctcaactgccaattaccagaacacgattacgagccaa

SEQ ID NO: 89 - DNA, 200 bp, Amaranthus graecizans
ttggctcgtaatcgtgttctggtaattggcagttgagcttgagcttgtggaacaatggatatatgataattttcgtggtcttctgaagaagatgggggagtgggttcgtgtatgagcaaaaaagcggaacgagatgtcggagtgcggcggacattgtagaatgctgctcgataacgccatcgcactcatctctctcgcac

SEQ ID NO: 90 - DNA, 200 bp, Amaranthus graecizans
ttaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatct

SEQ ID NO: 91 - DNA, 200 bp, Amaranthus graecizans
agatatagccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttttctccttctccttggctcgtaatcgtgttctggtaa

SEQ ID NO: 92 - DNA, 200 bp, Amaranthus graecizans
accatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgttccttccaagcctacggaccttcccttttttgatct

SEQ ID NO: 93 - DNA, 200 bp, Amaranthus graecizans
agatcaaaaaagggaaggtccgtaggcttggaaggaacaggccttaatttaccattccacagcacgaaacgaggggcattaggatctcccaagaccaaatcgtctttcaatccactgtcaaccgccatagtaagcacaggatcggagggttggaaactattaggaccctcttcccagatatagccatcggactccatggt

SEQ ID NO: 94 - DNA, 200 bp, Amaranthus graecizans
ctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgattgaacccttttgttctggtgtctatgctggtgatcct

SEQ ID NO: 95 - DNA, 200 bp, Amaranthus graecizans
aggatcaccagcatagacaccagaacaaaagggttcaatcaagcgttcgaagacctcatcgccgagattacggcgcacaaattcttcaacggattcctcataagaagaaggaggaggaggaggacgaagaccaagtgcaccaagaccagccctaatcttaccaggaaagctcatgagatcaaaaaagggaaggtccgtag

SEQ ID NO: 96 - DNA, 200 bp, Amaranthus graecizans
ttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaag

SEQ ID NO: 97 - DNA, 200 bp, Amaranthus graecizans
ctttcctaaaggatccaacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgcaggatcaccagcatagacaccagaa

SEQ ID NO: 98 - DNA, 200 bp, Amaranthus graecizans
cagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgttaggaccaaagcggttgtcatgactgtcccttcata

SEQ ID NO: 99 - DNA, 200 bp, Amaranthus graecizans
tatgaagggacagtcatgacaaccgctttggtcctaacagaaaccggtccatcgggtgtttgatatgtgagattgtattcaccattgagcgacttatcaatattagaaagtgtccacgatagtttgactttactgccaagcctagcagcaatggcggtaggtaacataatgagtcctttcctaaaggatccaacagtctg

SEQ ID NO: 100 - DNA, 200 bp, Amaranthus graecizans
cggttgtcatgactgtcccttcatacattgcaagtagcctgcttcgtccgctctcagatgttgctgcagattctctttctaaattttactatcctccagtcgcagcagtgtccctttcttatcccaaagaagcaattagaccagaatgcttgatcgatggagaactaaaaggattcgggcaattgcatccccgcagccag

SEQ ID NO: 101 - DNA, 200 bp, Amaranthus graecizans
ctggctgcggggatgcaattgcccgaatccttttagttctccatcgatcaagcattctggtctaattgcttctttgggataagaaagggacactgctgcgactggaggatagtaaaatttagaaagagaatctgcagcaacatctgagagcggacgaagcaggctacttgcaatgtatgaagggacagtcatgacaaccg

SEQ ID NO: 102 - DNA, 200 bp, Amaranthus graecizans
cgggcaattgcatccccgcagccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataa

SEQ ID NO: 103 - DNA, 200 bp, Amaranthus graecizans
ttatcagaatttttctgagatccttatcaactgtctccgcaagttcatcttcactcttttgtaatatgccaagatttgtagcacctccaatgtagctcaagatcaaggtcctaccgggtggtgctcgaccagggaaaagagatgaactataaattgttcccaaggtttccacaccctggctgcggggatgcaattgcccg

SEQ ID NO: 104 - DNA, 200 bp, Amaranthus graecizans
aaggatctcagaaaaattctgataaatccaaatgcgaaaggcagccgtgttctgggagtgagagtatggccaaaggcaatcccccaatttttagttggtcactttgatctgctagatgctgcaaaagctgctttggcaaatgctgggctaaaggggttgtttcttggtggtaattatgtatcaggtgttgccttggggag

SEQ ID NO: 105 - DNA, 200 bp, Amaranthus graecizans
ctccccaaggcaacacctgatacataattaccaccaagaaacaacccctttagcccagcatttgccaaagcagcttttgcagcatctagcagatcaaagtgaccaactaaaaattgggggattgcctttggccatactctcactcccagaacacggctgcctttcgcatttggatttatcagaatttttctgagatcctt

SEQ ID NO: 106 - DNA, 200 bp, Amaranthus graecizans
atgtatcaggtgttgccttggggaggtgtatagagggtgcttatgactctgcatctcaggtagtggatttcctctcacagtacaaagacaagtagtcagtagggctccagcatcctggttaagtaactttttgtagctgttgtaattcagatataaaatagcccacagtcaaacaagtttggaaagatgtaaaagcatga

SEQ ID NO: 107 - DNA, 200 bp, Amaranthus graecizans
tcatgcttttacatctttccaaacttgtttgactgtgggctattttatatctgaattacaacagctacaaaaagttacttaaccaggatgctggagccctactgactacttgtctttgtactgtgagaggaaatccactacctgagatgcagagtcataagcaccctctatacacctccccaaggcaacacctgatacat

SEQ ID NO: 108 - DNA, 200 bp, Amaranthus hybridus
gaagctaaacatcgtgttggaggtaatatcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttcc

SEQ ID NO: 109 - DNA, 200 bp, Amaranthus hybridus
ggaacaggccttaatttaccattccagagcacgaaacgaggggcattaggatctcccaagaccaaatcgtctttcaatccactgtcaaccgccatagtaagcacaggatcagagggttggaaactattaggaccctcttcccagatatagccatcggactccatggtagtgatattacctccaacacgatgtttagcttc

SEQ ID NO: 110 - DNA, 200 bp, Amaranthus hybridus
ggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaa

SEQ ID NO: 111 - DNA, 200 bp, Amaranthus hybridus
ttcgatcaagcgttcgaagacctcatcgccgagattacggcgcacaaattcttcaacagattcctcataagaagaaggaggaggaggacgacgaagaccaagtgcaccaagaccagccctaatcttaccaggaaagctcatgagatcaaaaaagggaaggtccgtaggtttggaaggaacaggccttaatttaccattcc

SEQ ID NO: 112 - DNA, 200 bp, Amaranthus hybridus
tgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaac

SEQ ID NO: 113 - DNA, 200 bp, Amaranthus hybridus
gtttaggaaggcgggggtctcgagggggtggaggattattcttcctttcctgaatagttttgagtgtaccggcgatgatactaccacccttttgctctaaggtccagacctttccaaatgcagctttcatactcaactttgtaggatcaccagcatacacaccagaacaaaagggttcgatcaagcgttcgaagacctca

SEQ ID NO: 114 - DNA, 200 bp, Amaranthus hybridus
cctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttag

SEQ ID NO: 115 - DNA, 200 bp, Amaranthus hybridus
ctaacagaaaccggtccatcgggtgtttgataagtgagaatgtattcaccattgagcgacttatcaatattagaaagtgtccacgatagtttgactttactgccaagcctagcagcaatggcggtaggtaacataatgagccctttcctaaaggatccaacagtctggcccttaggtttaggaaggcgggggtctcgagg

SEQ ID NO: 116 - DNA, 200 bp, Amaranthus hybridus
cacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaacta

SEQ ID NO: 117 - DNA, 200 bp, Amaranthus hybridus
tagttctccatcgatcaagcattctggtctaattgcttctttgggataagaaagggacactgctgcgactggtggatagtaaaacttagaaagagaatctgcagcaacatctgagagcggacgaagcaggctacttgcaatgtatgaagggacagtcatgacaaccgctttggtcctaacagaaaccggtccatcgggtg

SEQ ID NO: 118 - DNA, 200 bp, Amaranthus hybridus
agaatgcttgatcgatggagaactaaaaggattcgggcaattgcatccccgcagccagggtgtggaaaccttgggaacaatttatagttcatctcttttcccttggttcgagcaccacccggtaggaccttgatcttgagctacattggaggtgctacaaatgttggaatattacaaaagagtgaagatgaacttgcgga

SEQ ID NO: 119 - DNA, 200 bp, Amaranthus hybridus
tccgcaagttcatcttcactcttttgtaatattccaacatttgtagcacctccaatgtagctcaagatcaaggtcctaccgggtggtgctcgaaccaagggaaaagagatgaactataaattgttcccaaggtttccacaccctggctgcggggatgcaattgcccgaatccttttagttctccatcgatcaagcattct

SEQ ID NO: 120 - DNA, 200 bp, Amaranthus lividus
tagattgttgagagggaatgggcaattaagtggaatcccatttccttaaactcagctggtgtatgtaatggtgtctttccaccttcaatcatgtttgcaattctcaaacctttaacatctctaacaacctcttttagctcttctatgttggctggtgcctcaacaaatgtggcatcagcccctgcctctctgtaaagatt

SEQ ID NO: 121 - DNA, 200 bp, Amaranthus lividus
aatctttacagagaggcaggggctgatgccacatttgttgaggcaccagccaacatagaagagctaaaagaggttgttagagatgttaaaggtttgagaattgcaaacatgattgaaggtggaaagacaccattacatacaccagctgagtttaaggaaatgggattccacttaattgcccattccctctcaacaatcta

SEQ ID NO: 122 - DNA, 200 bp, Amaranthus lividus
cagcccctgcctctctgtaaagattagcacgtctaatagcttcttgaagaccgtgaggtgcacgagcatcagtccttgcaaccaagaagaaatcagattcaccaatggcttcccttgctgcagcgatcttaagggcgtgctcctctgcaggaacaactgccttaccacgcatgtgaccacacttctttggccatacttga

SEQ ID NO: 123 - DNA, 200 bp, Amaranthus lividus
tcaagtatggccaaagaagtgtggtcacatgcgtggtaaggcagttgttcctgcagaggagcacgcccttaagatcgctgcagcaagggaagccattggtgaatctgatttcttcttggttgcaaggactgatgctcgtgcacctcacggtcttcaagaagctattagacgtgctaatctttacagagaggcaggggctg

SEQ ID NO: 124 - DNA, 200 bp, Amaranthus lividus
accacacttctttggccatacttgatcctcaaggaaaacacccttggcaccagctgcgatcaagtctttgatgaacctttgaacattaagaggaccaccaccaccggtgtctccgtcaacaataacacacaaactaggagcagctgccgtaattctgcgaacaacatctaccacttctgcagttgtaagcaagccaaagt

SEQ ID NO: 125 - DNA, 200 bp, Amaranthus lividus
actttggcttgcttacaactgcagaagtggtagatgttgttcgcagaattacggcagctgctcctagtttgtgtgttattgttgacggagacaccggtggtggtggtcctcttaatgttcaaaggttcatcaaagacttgatcgcagctggtgccaagggtgttttccttgaggatcaagtatggccaaagaagtgtggt

SEQ ID NO: 126 - DNA, 200 bp, Amaranthus lividus
tctgcagttgtaagcaagccaaagtcgggcaagccaagaagagcagcggaaacaccaaaaccggagacaaagcaagctttgaagccggttttagcgcaaatggcggcggagaaagcgtcttggattccgggcattaaaattggtccctcctcggcgatcagacggtgcattgtggtctttccgactgcctcaagagaacc

SEQ ID NO: 127 - DNA, 200 bp, Amaranthus lividus
ggttctcttgaggcagtcggaaagaccacaatgcaccgtctgatcgccgaggagggaccaattttaatgcccggaatccaagacgctttctccgccgccatttgcgctaaaaccggcttcaaagcttgctttgtctccggttttggtgtttccgctgctcttcttggcttgcccgactttggcttgcttacaactgcaga

SEQ ID NO: 128 - DNA, 200 bp, Amaranthus lividus
tctttccgactgcctcaagagaacccatttttgtttctaataatacaatttaggaattaaggaaggaggtgatgatgagttgatagaactacttagtgtgtaattgttggagctggtatcagtggactttgcattgcgcaggctctttctaccaaacacattcaatccaatctcaatttcattgtcactgaagctaaaca

SEQ ID NO: 129 - DNA, 200 bp, Amaranthus lividus
tgtttagcttcagtgacaatgaaattgagattggattgaatgtgtttggtagaaagagcctgcgcaatgcaaagtccactgataccagctccaacaattacacactaagtagttctatcaactcatcatcacctccttccttaattcctaaattgtattattagaaacaaaaatgggttctcttgaggcagtcggaaaga

SEQ ID NO: 130 - DNA, 200 bp, Amaranthus lividus
atttcattgtcactgaagctaaacatcgtgttggaggtaatattactaccatggagtccgatggctatatctgggaagagggtcctaatagtttccaaccctctgatcctgtgcttactatggcggttgacagtggattgaaagacgatttggttttgggagatcctgatgcccctcgtttcgtgctctggaatggtaaa

SEQ ID NO: 131 - DNA, 200 bp, Amaranthus lividus
tttaccattccagagcacgaaacgaggggcatcaggatctcccaaaaccaaatcgtctttcaatccactgtcaaccgccatagtaagcacaggatcagagggttggaaactattaggaccctcttcccagatatagccatcggactccatggtagtaatattacctccaacacgatgtttagcttcagtgacaatgaaat

SEQ ID NO: 132 - DNA, 200 bp, Amaranthus lividus
tcgtttcgtgctctggaatggtaaattaaggcctgttccttctaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcg

SEQ ID NO: 133 - DNA, 200 bp, Amaranthus lividus
cgaagacctcatcgccgagattacggcgcacaaattcttcaacagattcctcataagaaggaggaggaggaggaggacgaagaccaagtgcaccaagaccagccctaatcttaccaggaaagctcatgagatcaaaaaagggaaggtccgtaggtttagaaggaacaggccttaatttaccattccagagcacgaaacga

SEQ ID NO: 134 - DNA, 200 bp, Amaranthus lividus
cgtaatctcggcgatgaggtcttcgaacgcttaatcgaacccttttgttctggtgtgtatgctggtgatcctacaaagttgagtatgaaagctgcatttggaaaggtctggaccttagagcaaaagggtggtagtatcatcgccggtacactcaaatctattcaggaaaggaagaataatcctccaccccctcgagaccc

SEQ ID NO: 135 - DNA, 200 bp, Amaranthus lividus
gggtctcgagggggtggaggattattcttcctttcctgaatagatttgagtgtaccggcgatgatactaccacccttttgctctaaggtccagacctttccaaatgcagctttcatactcaactttgtaggatcaccagcatacacaccagaacaaaagggttcgattaagcgttcgaagacctcatcgccgagattacg

SEQ ID NO: 136 - DNA, 200 bp, Amaranthus lividus
ataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatgga

SEQ ID NO: 137 - DNA, 200 bp, Amaranthus lividus
tccatcgggtgtttgataagtgagattgtattcaccattgagcgacttatcaatattagaaagtgtccacgatagtttgactttactgccaagcctagcagcaatggcggtaggtaacataatgagccctttcctaaaggatccaacagtctggcccttaggtttaggaaggcgggggtctcgagggggtggaggattat

SEQ ID NO: 138 - DNA, 200 bp, Amaranthus lividus
tctcacttatcaaacacccgatggaccggtttctgttaggaccaaagcggttgtcatgactgtaccttcatacattgcaagtagcctgcttcgtccactctcagatgttgctgcagattctctttctaagttttactatccaccagtcgcagcagtgtccctttcttatcccaaggaagcaattagaccagaatgcttga

SEQ ID NO: 139 - DNA, 200 bp, Amaranthus lividus
tcaagcattctggtctaattgcttccttgggataagaaagggacactgctgcgactggtggatagtaaaacttagaaagagaatctgcagcaacatctgagagtggacgaagcaggctacttgcaatgtatgaaggtacagtcatgacaaccgctttggtcctaacagaaaccggtccatcgggtgtttgataagtgaga

SEQ ID NO: 140 - DNA, 200 bp, Amaranthus lividus
gaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaaga

SEQ ID NO: 141 - DNA, 200 bp, Amaranthus lividus
tcttcactcttttgtaatattccaacatttgtagcacctccaatgtagctcaagatcaaggtcctaccgggtggtgctcgaccagggaaaagagatgaactataaattgttcccaaggtttccacaccctggctgcggggatgcaattgcccgaatccttttagttctccatcgatcaagcattctggtctaattgcttc

SEQ ID NO: 142 - DNA, 200 bp, Amaranthus lividus
ttggaatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaag

SEQ ID NO: 143 - DNA, 200 bp, Amaranthus lividus
ctttagcccagcatttgccaaaccagcttttgcagcatctagcagatcaaagtgaccaactaaaaattgggggattgcctttggccatactctcactcccagaacacggctgcctttcgcatttggatttatcagaatttttctgagatccttatcaactgtctccgcaagttcatcttcactcttttgtaatattccaa

SEQ ID NO: 144 - DNA, 200 bp, Amaranthus lividus
tggtttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcaatagggctccaccttcctggttaactaactttttgtagctgttgtaatttgtatc

SEQ ID NO: 145 - DNA, 200 bp, Amaranthus lividus
gatacaaattacaacagctacaaaaagttagttaaccaggaaggtggagccctattgactacttgtctttgtactgtgagaggaaatccactacctgagatgcagagtcataagcaccctctatacacctccccaaggcaacacctgatacataattaccaccaagaaacaacccctttagcccagcatttgccaaacca

SEQ ID NO: 146 - DNA, 200 bp, Amaranthus palmeri
aatccttgatttgaagataggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctc

SEQ ID NO: 147 - DNA, 200 bp, Amaranthus palmeri
gagcttgagcttgtggaacaatggatatatgataattttcgaggtcttccgaagaagatgggggagcgggttggtgtataagcagaaaagcggaaagagatgtcggagtgcggcggacattgtagaatgctgctcgataacgccatggcactcatctctcttgcactctctctggttatcctatcttcaaatcaaggatt

SEQ ID NO: 148 - DNA, 200 bp, Amaranthus palmeri
tccattgttccacaagctcaagctcaactgccaattaccagaacacgattacgacccaaggagaaggagataaagtattggattgtgtaattgttggagctggtatcagtggactttgcattgctcaggctctttctaccaaacacattcaatccaatctcaatttcattgtcactgaagctaaaaatcgtgttggaggt

SEQ ID NO: 149 - DNA, 200 bp, Amaranthus palmeri
acctccaacacgatttttagcttcagtgacaatgaaattgagattggattgaatgtgtttggtagaaagagcctgagcaatgcaaagtccactgataccagctccaacaattacacaatccaatactttatctccttctccttgggtcgtaatcgtgttctggtaattggcagttgagcttgagcttgtggaacaatgga

SEQ ID NO: 150 - DNA, 200 bp, Amaranthus palmeri
tgaagctaaaaatcgtgttggaggtaatatcactaccatggagtccgatggctatatctgggaagagggtcctaatagtttccaaccctccgatcctgtgcttactatggcggttgacagtggattgaaagatgatttggtcttgggagatcctaatgctcctcgttttgtgctctggaatggtaaattaaggcctgttc

SEQ ID NO: 151 - DNA, 200 bp, Amaranthus palmeri
gaacaggccttaatttaccattccagagcacaaaacgaggagcattaggatctcccaagaccaaatcatctttcaatccactgtcaaccgccatagtaagcacaggatcggagggttggaaactattaggaccctcttcccagatatagccatcggactccatggtagtgatattacctccaacacgatttttagcttca

SEQ ID NO: 152 - DNA, 200 bp, Amaranthus palmeri
tggaatggtaaattaaggcctgttccttccaaacctacggaccttcccttttttgatctcatgagctttcctggtaagattagggctggtcttggtgcacttggtcttcgtccttctcctcctcctccttcttatgaggaatctgttgaagaatttgtgcgccgtaatctcggcgatgaggtcttcgaacgcttgatcga

SEQ ID NO: 153 - DNA, 200 bp, Amaranthus palmeri
tcgatcaagcgttcgaagacctcatcgccgagattacggcgcacaaattcttcaacagattcctcataagaaggaggaggaggagaaggacgaagaccaagtgcaccaagaccagccctaatcttaccaggaaagctcatgagatcaaaaaagggaaggtccgtaggtttggaaggaacaggccttaatttaccattcca

SEQ ID NO: 154 - DNA, 200 bp, Amaranthus palmeri
atgaggtcttcgaacgcttgatcgaacccttttgttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaa

SEQ ID NO: 155 - DNA, 200 bp, Amaranthus palmeri
tttaggaaggcgggggtctcgaggcggtggaggattattcttcctttcctgaatagttttgagtgtaccggcgatgatactaccacccttttgctctaaggtccagacctttccaaatgcagctttcatactcaactttgaaggatcaccagcatacacaccagaacaaaagggttcgatcaagcgttcgaagacctcat

SEQ ID NO: 156 - DNA, 200 bp, Amaranthus palmeri
gcctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgtta

SEQ ID NO: 157 - DNA, 200 bp, Amaranthus palmeri
taacagaaaccggtccatcgggtgtttgataagtgagattgtattcaccattgagcgacttatcaatattagaaagtgtccacgatagtttgactttactgccaagcctagcagcaatggcggtaggtaacataatgagccctttcctaaaggatccaacagtctggcccttaggtttaggaaggcgggggtctcgaggc

SEQ ID NO: 158 - DNA, 200 bp, Amaranthus palmeri
acacccgatggaccggtttctgttaggaccaaagcggttgtcatgactgtcccttcatacattgcaagtagcctgcttcgtccgctctcatgatgttgctgcagattctctttctaaattttactatccaccagtcgcagcagtgtccctttcttatcccaaagaagcaattagaccagaatgcttgatcgatggagaac

SEQ ID NO: 159 - DNA, 200 bp, Amaranthus palmeri
gttctccatcgatcaagcattctggtctaattgcttctttgggataagaaagggacactgctgcgactggtggatagtaaaatttagaaagagaatctgcagcaacatcatgagagcggacgaagcaggctacttgcaatgtatgaagggacagtcatgacaaccgctttggtcctaacagaaaccggtccatcgggtgt

SEQ ID NO: 160 - DNA, 200 bp, Amaranthus palmeri
ccagaatgcttgatcgatggagaactaaaaggattcgggcaattgcatcccgcagccagggtgtggaaaccttgggaacaatttatagttcatctcttttccctggtcgagcaccacctggtaggaccttgatcttgagctacattggaggtgctacaaatgttggcatattacaaaagagtgaagatgaacttgcggag

SEQ ID NO: 161 - DNA, 200 bp, Amaranthus palmeri
ctccgcaagttcatcttcactcttttgtaatatgccaacatttgtagcacctccaatgtagctcaagatcaaggtcctaccaggtggtgctcgaccagggaaaagagatgaactataaattgttcccaaggtttccacaccctggctgcgggatgcaattgcccgaatccttttagttctccatcgatcaagcattctgg

SEQ ID NO: 162 - DNA, 200 bp, Amaranthus palmeri
aaagagtgaagatgaacttgcggagacagttgataaggatctcagaaaaattctgataaatccaaatgcgaaaggcagccgtgttctgggagtgagagtatggccaaaggcaatcccccaatttttagtaggtcattttgatctgctagatgctgcaaaagcgggtttggcaaatgctggactaaaggggttgtttcttg

SEQ ID NO: 163 - DNA, 200 bp, Amaranthus palmeri
caagaaacaacccctttagtccagcatttgccaaacccgcttttgcagcatctagcagatcaaaatgacctactaaaaattgggggattgcctttggccatactctcactcccagaacacggctgcctttcgcatttggatttatcagaatttttctgagatccttatcaactgtctccgcaagttcatcttcactcttt

SEQ ID NO: 164 - DNA, 200 bp, Amaranthus palmeri
gctggactaaaggggttgtttcttggtggtaattatgtatcaggtgttgccttggggaggtgtatagagggtgcttatgactctgcatctcaggttgtggatttcctctcacagtacaaagacaagtagtcatcctgattaactaactttttgtagctgttgtaatttgtatcatgtaatattattatttattcagatgt

SEQ ID NO: 165 - DNA, 200 bp, Amaranthus palmeri
acatctgaataaataataatattacatgatacaaattacaacagctacaaaaagttagttaatcaggatgactacttgtctttgtactgtgagaggaaatccacaacctgagatgcagagtcataagcaccctctatacacctccccaaggcaacacctgatacataattaccaccaagaaacaacccctttagtccagc

SEQ ID NO: 166 - DNA, 200 bp, Amaranthus palmeri
acataaaaccgctacatggaggcacggttttgtgtcaaatgtaaaccactactccatgtagcggtttggtgcacatacttttcaactctcagtgtgttgctgacgtggacggtagtgcgggaattattttacaaagtaacgtaaagtgggaattttttttaaataagctgcattttgggcaaagactctacttttacttt

SEQ ID NO: 167 - DNA, 200 bp, Amaranthus palmeri
aaagtaaaagtagagtctttgcccaaaatgcagcttatttaaaaaaaattcccactttacgttactttgtaaaataattcccgcactaccgtccacgtcagcaacacactgagagttgaaaagtatgtgcaccaaaccgctacatggagtagtggtttacatttgacacaaaaccgtgcctccatgtagcggttttatgt

SEQ ID NO: 168 - DNA, 200 bp, Amaranthus palmeri
tgggcaaagactctacttttacttttaattttatttttaattttaataaagaaggaagaaaaaaaacaaatgtatttatggataaagaatccttgatttgaagataggataaccagagagagggcaagagagatgagtgccatggcgttatcgagcagcattctacaatgtctgccgcactccgacatctctttccgctt

SEQ ID NO: 169 - DNA, 200 bp, Amaranthus palmeri
aagcggaaagagatgtcggagtgcggcagacattgtagaatgctgctcgataacgccatggcactcatctctcttgccctctctctggttatcctatcttcaaatcaaggattctttatccataaatacatttgttttttttcttccttctttattaaaattaaaaataaaattaaaagtaaaagtagagtctttgccca

SEQ ID NO: 170 - DNA, 200 bp, Amaranthus palmeri
cgcactccgacatctctttccgcttttctgcttatacaccaacccgctcccccatcttcttcggaagaccacgaaaattatcatatatccattgttccacaagctcaagctcaactgccaattaccagaacacgattacgacccaaggagaaggagataaagtattggattgtgtaattgttggagctggtatcagtgga

SEQ ID NO: 171 - DNA, 200 bp, Amaranthus palmeri
tccactgataccagctccaacaattacacaatccaatactttatctccttctccttgggtcgtaatcgtgttctggtaattggcagttgagcttgagcttgtggaacaatggatatatgataattttcgtggtcttccgaagaagatgggggagcgggttggtgtataagcagaaaagcggaaagagatgtcggagtgcg

SEQ ID NO: 172 - DNA, 200 bp, Amaranthus palmeri
aattgttggagctggtatcagtggactttgcattgctcaggctctttctactaaacacattcaatccaatctcaatttcattgtcactgaagctaaaaatcgtgttggaggtaatatcactaccatggagtccgatggctatatctgggaagagggtcctaatagtttccaaccctccgatcctgtgcttactatggcgg

SEQ ID NO: 173 - DNA, 200 bp, Amaranthus palmeri
ccgccatagtaagcacaggatcggagggttggaaactattaggaccctcttcccagatatagccatcggactccatggtagtgatattacctccaacacgatttttagcttcagtgacaatgaaattgagattggattgaatgtgtttagtagaaagagcctgagcaatgcaaagtccactgataccagctccaacaatt

SEQ ID NO: 174 - DNA, 200 bp, Amaranthus palmeri
tccgatcctgtgcttactatggcggtaaactcattcttctctctttctccaatttttgatcattctattcaattttccccttattgagtcaaaatcaaattccaggttgacagtggattgaaagatgatttggtcttgggagatcctaatgctcctcgttttgtgctctggaatggtaaattaaggcctgttccttccaa

SEQ ID NO: 175 - DNA, 200 bp, Amaranthus palmeri
ttggaaggaacaggccttaatttaccattccagagcacaaaacgaggagcattaggatctcccaagaccaaatcatctttcaatccactgtcaacctggaatttgattttgactcaataaggggaaaattgaatagaatgatcaaaaattggagaaagagagaagaatgagtttaccgccatagtaagcacaggatcgga

SEQ ID NO: 176 - DNA, 200 bp, Amaranthus palmeri
gtaaattaaggcctgttccttccaaacctacggaccttcccttttttgatctcatgagctttcctggtaagattagggctggtcttggtgcacttggtcttcgtccttctccccctcctccttcttatgaggaatctgttgaagagtttgtgcgccgtaatctcggcgatgaggtcttcgaacgcttgatcgaacccttt

SEQ ID NO: 177 - DNA, 200 bp, Amaranthus palmeri
aaagggttcgatcaagcgttcgaagacctcatcgccgagattacggcgcacaaactcttcaacagattcctcataagaaggaggagggggagaaggacgaagaccaagtgcaccaagaccagccctaatcttaccaggaaagctcatgagatcaaaaaagggaaggtccgtaggtttggaaggaacaggccttaatttac

SEQ ID NO: 178 - DNA, 200 bp, Amaranthus palmeri
cttcgaacgcttgatcgaacccttttgttctggtacctaccctgtttaatttttcagttttcccccttttttctctactactcctactttattgattcttatctatgagtgttctatgggaattgacattaattgttcaggtgtgtatgctggtgatccttcaaagttgagtatgaaagctgcatttggaaaggtctgga

SEQ ID NO: 179 - DNA, 200 bp, Amaranthus palmeri
tccagacctttccaaatgcagctttcatactcaactttgaaggatcaccagcatacacacctgaacaattaatgtcaattcccatagaacactcatagataagaatcaataaagtaggagtagtagagaaaaaagggggaaaactgaaaaattaaacagggtaggtaccagaacaaaagggttcgatcaagcgttcgaag

SEQ ID NO: 180 - DNA, 200 bp, Amaranthus palmeri
aaagctgcatttggaaaggtctggaccttagagcaaaagggtggtagtatcatcgccggtacactcaaaactattcaggaaaggaagaataatcctccaccgcctcgagacccgtccgtaatcaccattactcattgctttccttcaccttgtatcttaccttaatatacatgtatttaattgataatgtcacattgcct

SEQ ID NO: 181 - DNA, 200 bp, Amaranthus palmeri
aggcaatgtgacattatcaattaaatacatgtatattaaggtaagatacaaggtgaaggaaagcaatgagtaatggtgattacggacgggtctcgaggcggtggaggattattcttcctttcctgaatagttttgagtgtaccggcgatgatactaccacccttttgctctaaggtccagacctttccaaatgcagcttt

SEQ ID NO: 182 - DNA, 200 bp, Amaranthus palmeri
tttaattgataatgtcacattgcctcatttgcagccgccttcctaaacctaagggccagactgttggatcctttaggaaagggctcattatgttacctaccgccattgctgctaggtatcttttgactctcaaatcttaaatatttctcatcttttccttctgctaatactagtatgtttaccatctttttattttttta

SEQ ID NO: 183 - DNA, 200 bp, Amaranthus palmeri
taaaaaaataaaaagatggtaaacatactagtattagcagaaggaaaagatgagaaatatttaagatttgagagtcaaaagatacctagcagcaatggcggtaggtaacataatgagccctttcctaaaggatccaacagtctggcccttaggtttaggaaggcggctgcaaatgaggcaatgtgacattatcaattaaa

SEQ ID NO: 184 - DNA, 200 bp, Amaranthus palmeri
tgtttaccatctttttatttttttaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagt

SEQ ID NO: 185 - DNA, 200 bp, Amaranthus palmeri
actgagagcggacgaagcaggctacttgcaatgtatgaagggacagtcatgacaaccgctttggtcctaacagaaaccggtccatcgggtgtttgataagtgagattgtattcaccattgagcgacttatcaatattagaaagtgtccacgatagtttgactttactgccaagcctaaaaaaataaaaagatggtaaaca

SEQ ID NO: 186 - DNA, 200 bp, Amaranthus palmeri
gtagcctgcttcgtccgctctcagtgagtatcattctttccttcatttcttttcgtttattgctgtccaatgtcttgttaaacaccagtttggccttgtgctcgtgaattatggctacaatgttaactgattctgtgattcaggcactgtgggagatgcctaagtttctaaaacctctgcgcataatgtttgtttggatg

SEQ ID NO: 187 - DNA, 200 bp, Amaranthus palmeri
catccaaacaaacattatgcgcagaggttttagaaacttaggcatctcccacagtgcctgaatcacagaatcagttaacattgtagccataattcacgagcacaaggccaaactggtgtttaacaagacattggacagcaataaacgaaaagaaatgaaggaaagaatgatactcactgagagcggacgaagcaggctac

SEQ ID NO: 188 - DNA, 200 bp, Amaranthus palmeri
tctgcgcataatgtttgtttggatgttaggaattgcattgaaaaattgcttttgtgatgttgatgttaataccaattacaagtgtgttcttcaacttctgcaataccttgttcgagtgagcttgagggggtttagattagtgtccaatgtgaaactagcaaatgaactccaagcgctgggataggtccttgggatggagc

SEQ ID NO: 189 - DNA, 200 bp, Amaranthus palmeri
gctccatcccaaggacctatcccagcgcttggagttcatttgctagtttcacattggacactaatctaaaccccctcaagctcactcgaacaaggtattgcagaagttgaagaacacacttgtaattggtattaacatcaacatcacaaaagcaatttttcaatgcaattcctaacatccaaacaaacattatgcgcaga

SEQ ID NO: 190 - DNA, 200 bp, Amaranthus palmeri
ctgggataggtccttgggatggagcccctgatacccaagacagtattcaaaccctctaagtagagtgagagatcaaggaaagaaactgggtggttcctcaaatcgtaaaaaatgaatacagtgtcatgattgctaatcttatcacaaatcgtaaaaaatgaattatggtcgattttggactatttttgggtcattttgag

SEQ ID NO: 191 - DNA, 200 bp, Amaranthus palmeri
ctcaaaatgacccaaaaatagtccaaaatcgaccataattcattttttacgatttgtgataagattagcaatcatgacactgtattcattttttacgatttgaggaaccacccagtttctttccttgatctctcactctacttagagggtttgaatactgtcttgggtatcaggggctccatcccaaggacctatcccag

SEQ ID NO: 192 - DNA, 200 bp, Amaranthus palmeri
tggactatttttgggtcattttgagtgaatctcaaacttaaaaagcgagtcttctagcagttcttgttacagcggggcatacataggtaggaatttggttttttactatttgagccttttgactgttgtggccggtaatatggaatagtctagcacttctgcgtgtgtacaactagtatttattgtaattatgtgatcgc

SEQ ID NO: 193 - DNA, 200 bp, Amaranthus palmeri
gcgatcacataattacaataaatactagttgtacacacgcagaagtgctagactattccatattaccggccacaacagtcaaaaggctcaaatagtaaaaaaccaaattcctacctatgtatgccccgctgtaacaagaactgctagaagactcgctttttaagtttgagattcactcaaaatgacccaaaaatagtcca

SEQ ID NO: 194 - DNA, 200 bp, Amaranthus palmeri
gtatttattgtaattatgtgatcgcacttaactctcagataaaaccttaagcactaacattttgttttggttgaaggaatcaggaggaaagaaaattgagggatttgttggtatatagattcctttgtttggataacaaaattggagtggagagatttggaaggaagaattttatagggattagttcccattacacttat

SEQ ID NO: 195 - DNA, 200 bp, Amaranthus palmeri
ataagtgtaatgggaactaatccctataaaattcttccttccaaatctctccactccaattttgttatccaaacaaaggaatctatataccaacaaatccctcaattttctttcctcctgattccttcaaccaaaacaaaatgttagtgcttaaggttttatctgagagttaagtgcgatcacataattacaataaatac

SEQ ID NO: 196 - DNA, 200 bp, Amaranthus palmeri
attatatgtcatgtaatataaatagaaaattattatttaaataattaatttcaaactttgtatcaataaaacacttaattttttgattattagagtgtatatgaaaaatatgtaaaaaaaagtcgtacataagaaaatttcattgtaattaagactaaatttgatgaatcgattcgtaaaattgctctatgatcctacaa

SEQ ID NO: 197 - DNA, 200 bp, Amaranthus palmeri
ttgtaggatcatagagcaattttacgaatcgattcatcaaatttagtcttaattacaatgaaattttcttatgtacgacttttttttacatatttttcatatacactctaataatcaaaaaattaagtgttttattgatacaaagtttgaaattaattatttaaataataattttctatttatattacatgacatataat

SEQ ID NO: 198 - DNA, 200 bp, Amaranthus palmeri
gtaaaattgctctatgatcctacaacccacttatttatttcaattaggactgtaattaagtttaaatttacattagttgaattattgccttttatgagagatgtggtatcgtatgctatctaaaggctaaaactattaagtcgatttaaaatctatccaaattttatacttaattgaactaggttgaattgaacggagaa

SEQ ID NO: 199 - DNA, 200 bp, Amaranthus palmeri
ttctccgttcaattcaacctagttcaattaagtataaaatttggatagattttaaatcgacttaatagttttagcctttagatagcatacgataccacatctctcataaaaggcaataattcaactaatgtaaatttaaacttaattacagtcctaattgaaataaataagtgggttgtaggatcatagagcaattttac

SEQ ID NO: 200 - DNA, 200 bp, Amaranthus palmeri
gaactaggttgaattgaacggagaattaatcaaaaatgtaccacccttgaatcactatcaatattaaagcaaaccaactttaatccataaatgaaaatcaacttagtcaaatcacatatgaacccgtcaatcatgccaaaaactctgagagtgtttgatattataacttattagaaaattttaacttatttgacgcaaat

SEQ ID NO: 201 - DNA, 200 bp, Amaranthus palmeri
atttgcgtcaaataagttaaaattttctaataagttataatatcaaacactctcagagtttttggcatgattgacgggttcatatgtgatttgactaagttgattttcatttatggattaaagttggtttgctttaatattgatagtgattcaagggtggtacatttttgattaattctccgttcaattcaacctagttc

SEQ ID NO: 202 - DNA, 200 bp, Amaranthus palmeri
aaattttaacttatttgacgcaaatagacggataagtgttctaaccatctagctctagtgtttcgcttaataaaaataaataatttttaaacatgctcctataaatcaactgatcaaaccggtttataaaatcaccaactaaatcgacccattcaaatcaaataccaactcggtcgtttgccaaacacttcgctatgact

SEQ ID NO: 203 - DNA, 200 bp, Amaranthus palmeri
agtcatagcgaagtgtttggcaaacgaccgagttggtatttgatttgaatgggtcgatttagttggtgattttataaaccggtttgatcagttgatttataggagcatgtttaaaaattatttatttttattaagcgaaacactagagctagatggttagaacacttatccgtctatttgcgtcaaataagttaaaattt

SEQ ID NO: 204 - DNA, 200 bp, Amaranthus palmeri
gtttgccaaacacttcgctatgacttcaatcaaacaaaatgcaacttgtttgctgctaccgacttaccgccttacccagtacgcggaaaagataatcaatgagaatcaaattcaaatcttgacaagataatatgattatcccattattatcaatttaattatgattaaccttttttaagataacctaataattcattgat

SEQ ID NO: 205 - DNA, 200 bp, Amaranthus palmeri
atcaatgaattattaggttatcttaaaaaaggttaatcataattaaattgataataatgggataatcatattatcttgtcaagatttgaatttgattctcattgattatcttttccgcgtactgggtaaggcggtaagtcggtagcagcaaacaagttgcattttgtttgattgaagtcatagcgaagtgtttggcaaac

SEQ ID NO: 206 - DNA, 200 bp, Amaranthus palmeri
taagataacctaataattcattgataagaatgattagcttgtttaatcaacttcaatttacaatttctaccttggaaaattcaaaccaaaaagtgtaaaagaattgatttggcagattgcgacaattggattgagaaattgacaaatttaaactgatcttatggtaattcaatccataacccacctttcaccaaaacttg

SEQ ID NO: 207 - DNA, 200 bp, Amaranthus palmeri
caagttttggtgaaaggtgggttatggattgaattaccataagatcagtttaaatttgtcaatttctcaatccaattgtcgcaatctgccaaatcaattcttttacactttttggtttgaattttccaaggtagaaattgtaaattgaagttgattaaacaagctaatcattcttatcaatgaattattaggttatctta

SEQ ID NO: 208 - DNA, 200 bp, Amaranthus palmeri
ataacccacctttcaccaaaacttgcattgccatcgccattgtcaatttccgccaagaactacccagtagctgtaatgggcaacatttctgagcgggaagaacccagtaagtcaacctttcttcatatatcttaagcaatcccttttgaactacactttcttttgatgattttacattctgaattgtttttattggggat

SEQ ID NO: 209 - DNA, 200 bp, Amaranthus palmeri
atccccaataaaaacaattcagaatgtaaaatcatcaaaagaaagtgtagttcaaaagggattgcttaagatatatgaagaaaggttgacttactgggttcttcccgctcagaaatgttgcccattacagctactgggtagttcttggcggaaattgacaatggcgatggcaatgcaagttttggtgaaaggtgggttat

SEQ ID NO: 210 - DNA, 200 bp, Amaranthus palmeri
attctgaattgtttttattggggattttcagcttctgcgaaaagggttgctgttgttggtgctggagttaggtaaattttatgttacttttccagaaagattgtgaaattttgctttgattgttctgaattttgatgggtttttgcataatgatttgtatttgggatgggcaaatttttcagaagatcatactacttttt

SEQ ID NO: 211 - DNA, 200 bp, Amaranthus palmeri
aaaaagtagtatgatcttctgaaaaatttgcccatcccaaatacaaatcattatgcaaaaacccatcaaaattcagaacaatcaaagcaaaatttcacaatctttctggaaaagtaacataaaatttacctaactccagcaccaacaacagcaacccttttcgcagaagctgaaaatccccaataaaaacaattcagaat

SEQ ID NO: 212 - DNA, 200 bp, Amaranthus palmeri
ttttcagaagatcatactactttttaacttgtgttttctgtagaattttattgattttctaaactgtttttgtgggattgttctagtggacttgctgctgcatataagctaaaatcccatggtttgagtgtgacattgtttgaagctgattctagagctggaggcaagcttaaaactgttaaaaaagatggttttatttg

SEQ ID NO: 213 - DNA, 200 bp, Amaranthus palmeri
caaataaaaccatcttttttaacagttttaagcttgcctccagctctagaatcagcttcaaacaatgtcacactcaaaccatgggattttagcttatatgcagcagcaagtccactagaacaatcccacaaaaacagtttagaaaatcaataaaattctacagaaaacacaagttaaaaagtagtatgatcttctgaaaa

SEQ ID NO: 214 - DNA, 200 bp, Amaranthus palmeri
ctgttaaaaaagatggttttatttgggatgagggggcaaatactatggtaatgtttatcaacaatgctggttttctgatatagaaccaattacttatttattaactggatttttggtcaaacctgtggttggcatgtcactttatgctatgattgtagacagaaagtgaggcagaggtgtcgagtttgatcgatgatctt

SEQ ID NO: 215 - DNA, 200 bp, Amaranthus palmeri
aagatcatcgatcaaactcgacacctctgcctcactttctgtctacaatcatagcataaagtgacatgccaaccacaggtttgaccaaaaatccagttaataaataagtaattggttctatatcagaaaaccagcattgttgataaacattaccatagtatttgccccctcatcccaaataaaaccatcttttttaacag

SEQ ID NO: 216 - DNA, 200 bp, Amaranthus palmeri
ggtgtcgagtttgatcgatgatcttgggcttcgtgagaagcaacagttggtaagttttccgtctaagcccattccctttgctctctaggtgcaaaaatacggtaatagtcatgatcgtggtaatgacatggtgatgcggtgacgggagttatgtgatcgctattccaactataggtcgaaaacatgatattttccttgtg

SEQ ID NO: 217 - DNA, 200 bp, Amaranthus palmeri
cacaaggaaaatatcatgttttcgacctatagttggaatagcgatcacataactcccgtcaccgcatcaccatgtcattaccacgatcatgactattaccgtatttttgcacctagagagcaaagggaatgggcttagacggaaaacttaccaactgttgcttctcacgaagcccaagatcatcgatcaaactcgacacc

SEQ ID NO: 218 - DNA, 200 bp, Amaranthus palmeri
tcgaaaacatgatattttccttgtgacgttccgaaatgcggtatttttacacctttacattgcggggaaaaataggtttagtttttttgaatacctttacaaggcggctgatgcgatgaagccttgtttttgcattatgtgctagaagcaaattattatatctttaattaatgtaatgtatcatcagcttaaaacagcct

SEQ ID NO: 219 - DNA, 200 bp, Amaranthus palmeri
aggctgttttaagctgatgatacattacattaattaaagatataataatttgcttctagcacataatgcaaaaacaaggcttcatcgcatcagccgccttgtaaaggtattcaaaaaaactaaacctatttttccccgcaatgtaaaggtgtaaaaataccgcatttcggaacgtcacaaggaaaatatcatgttttcga

SEQ ID NO: 220 - DNA, 200 bp, Amaranthus palmeri
atgtatcatcagcttaaaacagccttattgtacttcttaatctagttttgacttttgaggttgcttttacgagatccttataaattgctttttctgtcacagccaatttcacaaaataaaaggtacatagctagagatggtcttccggtgctagtaagtcctctgcattttcttttgacctctatgaacttctaacactg

SEQ ID NO: 221 - DNA, 200 bp, Amaranthus palmeri
cagtgttagaagttcatagaggtcaaaagaaaatgcagaggacttactagcaccggaagaccatctctagctatgtaccttttattttgtgaaattggctgtgacagaaaaagcaatttataaggatctcgtaaaagcaacctcaaaagtcaaaactagattaagaagtacaataaggctgttttaagctgatgatacat

SEQ ID NO: 222 - DNA, 200 bp, Amaranthus palmeri
tgacctctatgaacttctaacactggatactgagttgtatttgtattcgaggcaaattctatattttccaatctgtttcttattgacagttacttgcaacctttgcagctaccttcaaatcccgctgcactgctcacgagcaatttcctttcagcaaaatcaaaggttatttatgctaaaacatgtttgtttgttttttt

SEQ ID NO: 223 - DNA, 200 bp, Amaranthus palmeri
aaaaaaacaaacaaacatgttttagcataaataacctttgattttgctgaaaggaaattgctcgtgagcagtgcagcgggatttgaaggtagctgcaaaggttgcaagtaactgtcaataagaaacagattggaaaatatagaatttgcctcgaatacaaatacaactcagtatccagtgttagaagttcatagaggtca

SEQ ID NO: 224 - DNA, 200 bp, Amaranthus palmeri
ctaaaacatgtttgtttgtttttttttaacttagcttttggtgtatgcaataatttggtttctaaaactaagtgattgaccgaaaaggagggacaaaggacatagaattgcaaatttttgttcttgacgtatttttacttttagagcatccccttgtgtaaaacttttattttagagctgcaagaatttgttgcatcttt

SEQ ID NO: 225 - DNA, 200 bp, Amaranthus palmeri
aaagatgcaacaaattcttgcagctctaaaataaaagttttacacaaggggatgctctaaaagtaaaaatacgtcaagaacaaaaatttgcaattctatgtcctttgtccctccttttcggtcaatcacttagttttagaaaccaaattattgcatacaccaaaagctaagttaaaaaaaaacaaacaaacatgttttag

SEQ ID NO: 226 - DNA, 200 bp, Amaranthus palmeri
agctgcaagaatttgttgcatcttttgttatgatttaattttgatgcttttagctgcaacagtttgttgataaaaaggccactgcttttttctcagctgcaaattatgttggaaccatttctctggaaaaaacgcaatgctactgagctttctgatgagcatgttcaggaaaggcaagtgcccttgctctatctatactg

SEQ ID NO: 227 - DNA, 200 bp, Amaranthus palmeri
cagtatagatagagcaagggcacttgcctttcctgaacatgctcatcagaaagctcagtagcattgcgttttttccagagaaatggttccaacataatttgcagctgagaaaaaagcagtggcctttttatcaacaaactgttgcagctaaaagcatcaaaattaaatcataacaaaagatgcaacaaattcttgcagct

SEQ ID NO: 228 - DNA, 200 bp, Amaranthus palmeri
aagtgcccttgctctatctatactgatggaaaggattatcgctgaatttaccttctactgaaacatcaataaaatacttcattattagcatcaaaatactccctccatccttctggttttgctggactttccctatgaaggtgttcaaggagtagcttgctacctttcaagatagggtagtggttgccttctcgcaaaat

SEQ ID NO: 229 - DNA, 200 bp, Amaranthus palmeri
attttgcgagaaggcaaccactaccctatcttgaaaggtagcaagctactccttgaacaccttcatagggaaagtccagcaaaaccagaaggatggagggagtattttgatgctaataatgaagtattttattgatgtttcagtagaaggtaaattcagcgataatcctttccatcagtatagatagagcaagggcactt

SEQ ID NO: 230 - DNA, 200 bp, Amaranthus palmeri
ggtagtggttgccttctcgcaaaatttcagtcactcgttttcctctcctaattcaagccatactttttatggttcctccacacaactcttgctaaatttgaaaagtagcaaagaggaagtgagcaaaatcagcaggagtaggactgatgagtaagagcttgatcaagtataaaggatatgtttctatgtagaatatgaat

SEQ ID NO: 231 - DNA, 200 bp, Amaranthus palmeri
attcatattctacatagaaacatatcctttatacttgatcaagctcttactcatcagtcctactcctgctgattttgctcacttcctctttgctacttttcaaatttagcaagagttgtgtggaggaaccataaaaagtatggcttgaattaggagaggaaaacgagtgactgaaattttgcgagaaggcaaccactacc

SEQ ID NO: 232 - DNA, 200 bp, Amaranthus palmeri
atatgtttctatgtagaatatgaatgcattacctgtagaattgacataatgatttgtctgcagtgttggcgaattttttgagcgacattttgggaaagaggtattgttgccaacttgccatgctctattccggtgaattaacaaatgttgcgcttctgcttactattgcttataattattgtttttttgcagtttgttga

SEQ ID NO: 233 - DNA, 200 bp, Amaranthus palmeri
tcaacaaactgcaaaaaaacaataattataagcaatagtaagcagaagcgcaacatttgttaattcaccggaatagagcatggcaagttggcaacaatacctctttcccaaaatgtcgctcaaaaaattcgccaacactgcagacaaatcattatgtcaattctacaggtaatgcattcatattctacatagaaacatat

SEQ ID NO: 234 - DNA, 200 bp, Amaranthus palmeri
ttattgtttttttgcagtttgttgattatgttattgacccttttgttgcgggtacatgtggtggagatcctcaatcgctatctgtaagttaaatactgtgccttctttttttttctcaaaattttctggaggttgtaaataaattatactccctcctattataatcaactgtcctatttccccttttggtatattcaaag

SEQ ID NO: 235 - DNA, 200 bp, Amaranthus palmeri
ctttgaatataccaaaaggggaaataggacagttgattataataggagggagtataatttatttacaacctccagaaaattttgagaaaaaaaaagaaggcacagtatttaacttacagatagcgattgaggatctccaccacatgtacccgcaacaaaagggtcaataacataatcaacaaactgcaaaaaaacaataa

SEQ ID NO: 236 - DNA, 200 bp, Amaranthus palmeri
atttccccttttggtatattcaaagtgagttaaatattgccatccattaaatttcactttgtcccttacttattttttcccttactcactcctctcatgtggtcccttaaactcggtgcattaccaaataggactattgattgaaataggagggagtatccgattgtgcttccaaaggtagttcaactcctcttcttttt

SEQ ID NO: 237 - DNA, 200 bp, Amaranthus palmeri
aaaaagaagaggagttgaactacctttggaagcacaatcggatactccctcctatttcaatcaatagtcctatttggtaatgcaccgagtttaagggaccacatgagaggagtgagtaagggaaaaaataagtaagggacaaagtgaaatttaatggatggcaatatttaactcactttgaatataccaaaaggggaaat

SEQ ID NO: 238 - DNA, 200 bp, Amaranthus palmeri
aggtagttcaactcctcttctttttctttaaatttttgtaccatactgtgcattttgaaccttaactcatttcgccatgaaggagtattatatttgagaagaacgcagatactattatcttatacattaggtttcattatcaatgattgtttgattgtcaactcctcttttccctttcatgctcatattgatgttatttc

SEQ ID NO: 239 - DNA, 200 bp, Amaranthus palmeri
gaaataacatcaatatgagcatgaaagggaaaagaggagttgacaatcaaacaatcattgataatgaaacctaatgtataagataatagtatctgcgttcttctcaaatataatactccttcatggcgaaatgagttaaggttcaaaatgcacagtatggtacaaaaatttaaagaaaaagaagaggagttgaactacct

SEQ ID NO: 240 - DNA, 200 bp, Amaranthus palmeri
ttcatgctcatattgatgttatttctatttggttatgaattttgtgtattgtgttaatgtcttactttattgtagatgcaccatacatttcccgacgtatggaatgttgaaaaaaggtatgaatcttaaagctttaattttcttcgaacgttatgtttcataattgattctttgggatcaatttccgtaagaacgataat

SEQ ID NO: 241 - DNA, 200 bp, Amaranthus palmeri
attatcgttcttacggaaattgatcccaaagaatcaattatgaaacataacgttcgaagaaaattaaagctttaagattcataccttttttcaacattccatacgtcgggaaatgtatggtgcatctacaataaagtaagacattaacacaatacacaaaattcataaccaaatagaaataacatcaatatgagcatgaa

SEQ ID NO: 242 - DNA, 200 bp, Amaranthus palmeri
gatcaatttccgtaagaacgataatttgaaaaaatttatgaaccttcaagctttcttcgaatttatatgctttgtaattcatgcttttagatgctgcaccattttatctatgtgtcttaagtttggtgtaatcatttgtatagcaaaagaatgaatggtctggtttgaaatggttcatagtgcaaaatgtgattgtgctt

SEQ ID NO: 243 - DNA, 200 bp, Amaranthus palmeri
aagcacaatcacattttgcactatgaaccatttcaaaccagaccattcattcttttgctatacaaatgattacaccaaacttaagacacatagataaaatggtgcagcatctaaaagcatgaattacaaagcatataaattcgaagaaagcttgaaggttcataaattttttcaaattatcgttcttacggaaattgatc

SEQ ID NO: 244 - DNA, 200 bp, Amaranthus palmeri
catagtgcaaaatgtgattgtgcttgcgattgaggtaacattcaaggtgatgcgattgtcgtactgtcaattgtcgtcctataccatgtgatatttgaataagcctaaaatgccatattgtacacctttaggatgtggacaaaatgggttcggtttcggtacatatgacaaatccttgcaatttgatctgtacgatacaa

SEQ ID NO: 245 - DNA, 200 bp, Amaranthus palmeri
ttgtatcgtacagatcaaattgcaaggatttgtcatatgtaccgaaaccgaacccattttgtccacatcctaaaggtgtacaatatggcattttaggcttattcaaatatcacatggtataggacgacaattgacagtacgacaatcgcatcaccttgaatgttacctcaatcgcaagcacaatcacattttgcactatg

SEQ ID NO: 246 - DNA, 200 bp, Amaranthus palmeri
ttgcaatttgatctgtacgatacaatgcgattttgtcttttgctttatgatggtgattccatatgcgattttagggcttagaaatttcccttgttcaagaacatctcaatcaatctttaaccaatttcaaccacattaaattgcgtcaaagtcgaactttataattcactcccaatctctgagatatccaaactccaaaa

SEQ ID NO: 247 - DNA, 200 bp, Amaranthus palmeri
ttttggagtttggatatctcagagattgggagtgaattataaagttcgactttgacgcaatttaatgtggttgaaattggttaaagattgattgagatgttcttgaacaagggaaatttctaagccctaaaatcgcatatggaatcaccatcataaagcaaaagacaaaatcgcattgtatcgtacagatcaaattgcaa

SEQ ID NO: 248 - DNA, 200 bp, Amaranthus palmeri
tctctgagatatccaaactccaaaagttctattggctttcatgttttcacaaagtaacgttggtgggactccttaccattttctttattatgcatttcgttgatgtataatagtatagattggtgctcttttcgctgtccttctaacatgcataacttcactagttcttatcgttttcttttcctccctatttttatttg

SEQ ID NO: 249 - DNA, 200 bp, Amaranthus palmeri
caaataaaaatagggaggaaaagaaaacgataagaactagtgaagttatgcatgttagaaggacagcgaaaagagcaccaatctatactattatacatcaacgaaatgcataataaagaaaatggtaaggagtcccaccaacgttactttgtgaaaacatgaaagccaatagaacttttggagtttggatatctcagaga

SEQ ID NO: 250 - DNA, 200 bp, Amaranthus palmeri
ttcttttcctccctatttttatttgacttgtagctatctatgttcactcttctcgcccaatccaatgttatcttctactccatgcttgcaaaagccacaaaatgctcactccaccaataagaggaaattgccagtccaccacttgctggaggcatccatggaagctgaagtatttttgtcctctactcataggatgcata

SEQ ID NO: 251 - DNA, 200 bp, Amaranthus palmeri
tatgcatcctatgagtagaggacaaaaatacttcagcttccatggatgcctccagcaagtggtggactggcaatttcctcttattggtggagtgagcattttgtggcttttgcaagcatggagtagaagataacattggattgggcgagaagagtgaacatagatagctacaagtcaaataaaaatagggaggaaaagaa

SEQ ID NO: 252 - DNA, 200 bp, Amaranthus palmeri
ttgtcctctactcataggatgcatacatgcatcgatttactttctaatactcctttaacttgattccgattagctctgctcttaacaggtgttgctagaaaacatcaactattttcagcataaattaaatgtgagcattacctaataacgtgaaaactatcaaatcttgtttgtagtgcaatattgcgttttcggttgcg

SEQ ID NO: 253 - DNA, 200 bp, Amaranthus palmeri
cgcaaccgaaaacgcaatattgcactacaaacaagatttgatagttttcacgttattaggtaatgctcacatttaatttatgctgaaaatagttgatgttttctagcaacacctgttaagagcagagctaatcggaatcaagttaaaggagtattagaaagtaaatcgatgcatgtatgcatcctatgagtagaggacaa

SEQ ID NO: 254 - DNA, 200 bp, Amaranthus palmeri
attattgtgtaattcttccctcacgtctctattgtcttcatttttttagaaaaataaataaagcttggttttatagattttgtaactgatatgcaatacatttgcgtttgctttcagttattgattcaaaaacaataatgctaaagccctaatcctaacatgttgtgtcatctgttgaaacaatacttgaaatcgctata

SEQ ID NO: 255 - DNA, 200 bp, Amaranthus palmeri
tatagcgatttcaagtattgtttcaacagatgacacaacatgttaggattagggctttagcattattgtttttgaatcaataactgaaagcaaacgcaaatgtattgcatatcagttacaaaatctataaaaccaagctttatttatttttctaaaaaaatgaagacaatagagacgtgagggaagaattacacaataat

SEQ ID NO: 256 - DNA, 200 bp, Amaranthus palmeri
tgaaacaatacttgaaatcgctataaaaagggatttttgtcgggtacttcagttgttgaaattgatatggtcaagtacaattcattttaacccaatttgtaatgatttactggcttggtttcttagctgtttgttttaataaaggattttagttcggtatttggttgttgaaaaaattgatatggccaagtaatggtcat

SEQ ID NO: 257 - DNA, 200 bp, Amaranthus palmeri
atgaccattacttggccatatcaattttttcaacaaccaaataccgaactaaaatcctttattaaaacaaacagctaagaaaccaagccagtaaatcattacaaattgggttaaaatgaattgtacttgaccatatcaatttcaacaactgaagtacccgacaaaaatccctttttatagcgatttcaagtattgtttca

SEQ ID NO: 258 - DNA, 200 bp, Amaranthus palmeri
attgatatggccaagtaatggtcatattaacacaattggtaatgttttattagctcaatagtgtttgttaagtatgtgactcaaatttaatcaagtataacttattgaagcgtagttcttttatccattaggtttggctctgtgtttgctggactaattcaatcaacattgttatctaagaaggaaaagggtggaggaga

SEQ ID NO: 259 - DNA, 200 bp, Amaranthus palmeri
tctcctccacccttttccttcttagataacaatgttgattgaattagtccagcaaacacagagccaaacctaatggataaaagaactacgcttcaataagttatacttgattaaatttgagtcacatacttaacaaacactattgagctaataaaacattaccaattgtgttaatatgaccattacttggccatatcaat

SEQ ID NO: 260 - DNA, 200 bp, Amaranthus palmeri
ctaagaaggaaaagggtggaggagaaaatgcttctatcaagaagcctcgtgtacgcggttcattttcattccatggtggaatgcaggtataaccttatagccataatttcgctttttataccttatacttccaaaatatattgatgcattttcttgctacaatcacaaaagctttgggaaaaattctcaattttgtcaaa

SEQ ID NO: 261 - DNA, 200 bp, Amaranthus palmeri
tttgacaaaattgagaatttttcccaaagcttttgtgattgtagcaagaaaatgcatcaatatattttggaagtataaggtataaaaagcgaaattatggctataaggttatacctgcattccaccatggaatgaaaatgaaccgcgtacacgaggcttcttgatagaagcattttctcctccacccttttccttcttag

SEQ ID NO: 262 - DNA, 200 bp, Amaranthus palmeri
gggaaaaattctcaattttgtcaaatctactaaaataattcattttggaaccaaggttttctatttcagaatacatggatgaagacatgcagtaagtatggataaaataatctagatgtaaaaggtttttagtctattaagcaagaatattataattcagagtcgtttcatcaataaagtgttgtttaagtgcagcaatt

SEQ ID NO: 263 - DNA, 200 bp, Amaranthus palmeri
aattgctgcacttaaacaacactttattgatgaaacgactctgaattataatattcttgcttaatagactaaaaaccttttacatctagattattttatccatacttactgcatgtcttcatccatgtattctgaaatagaaaaccttggttccaaaatgaattattttagtagatttgacaaaattgagaatttttccc

SEQ ID NO: 264 - DNA, 200 bp, Amaranthus palmeri
aaagtgttgtttaagtgcagcaattacattctgcttcaagcaaaggctatcttaagacttaagaggctcccaaaacatgaggaggtatgagaccttagaggccaaagaaataaaatttgatgaggagacttggtgagataccttgcttccaaaaatgatatatttttccccttagacacctcagattatgacatttataa

SEQ ID NO: 265 - DNA, 200 bp, Amaranthus palmeri
ttataaatgtcataatctgaggtgtctaaggggaaaaatatatcatttttggaagcaaggtatctcaccaagtctcctcatcaaattttatttctttggcctctaaggtctcatacctcctcatgttttgggagcctcttaagtcttaagatagcctttgcttgaagcagaatgtaattgctgcacttaaacaacacttt

SEQ ID NO: 266 - DNA, 200 bp, Amaranthus palmeri
acacctcagattatgacatttataaggtgtccctgcgtattcgacgagattttacgacctatactctaaagtctaaattgagtgagaaatgtgtatatgtgtaagaaaggaaagttagtaccatgaattccatgtctacgacctcaaagtgttcataccattgaaattagtgagcttacaattgttaagaaagcatcaac

SEQ ID NO: 267 - DNA, 200 bp, Amaranthus palmeri
gttgatgctttcttaacaattgtaagctcactaatttcaatggtatgaacactttgaggtcgtagacatggaattcatggtactaactttcctttcttacacatatacacatttctcactcaatttagactttagagtataggtcgtaaaatctcgtcgaatacgcagggacaccttataaatgtcataatctgaggtgt

SEQ ID NO: 268 - DNA, 200 bp, Amaranthus palmeri
ttacaattgttaagaaagcatcaactattcataattgatcattgatgaagtgtgtaatagacatgctaggtgaaattcgaaagggatctactctgtctttgagtttacaatttgcttctagtttttagctatttataggtgctatcaaagggttgaatattgttttttctgaacattgttgccgagttgtgaagggagaa

SEQ ID NO: 269 - DNA, 200 bp, Amaranthus palmeri
ttctcccttcacaactcggcaacaatgttcagaaaaaacaatattcaaccctttgatagcacctataaatagctaaaaactagaagcaaattgtaaactcaaagacagagtagatccctttcgaatttcacctagcatgtctattacacacttcatcaatgatcaattatgaatagttgatgctttcttaacaattgtaa

SEQ ID NO: 270 - DNA, 200 bp, Amaranthus palmeri
ttgttgccgagttgtgaagggagaatgatggtagatttctcttaatgagaacattctcttcataaagagttcgatagcgcaaaaacgaaagcttattgccaaaagtggctggggtagatgaaagagaactgcaattgattttgctaggcttgactttgagtaaagaattcatggcataaggtagaaaaataggagatggc

SEQ ID NO: 271 - DNA, 200 bp, Amaranthus palmeri
gccatctcctatttttctaccttatgccatgaattctttactcaaagtcaagcctagcaaaatcaattgcagttctctttcatctaccccagccacttttggcaataagctttcgtttttgcgctatcgaactctttatgaagagaatgttctcattaagagaaatctaccatcattctcccttcacaactcggcaacaa

SEQ ID NO: 272 - DNA, 200 bp, Amaranthus palmeri
ataaggtagaaaaataggagatggctgaatgatatcgaaaccttttgattctttttgttttgtttgcaatgcacagaaaggcaggacgggaaagtgtgattaaatggatgggaaaaattgctagaatagaaaagaagaaagatgtagcactcacgtgaggaaattacccaatatctgaatggagctcacactcctctctt

SEQ ID NO: 273 - DNA, 200 bp, Amaranthus palmeri
aagagaggagtgtgagctccattcagatattgggtaatttcctcacgtgagtgctacatctttcttcttttctattctagcaatttttcccatccatttaatcacactttcccgtcctgcctttctgtgcattgcaaacaaaacaaaaagaatcaaaaggtttcgatatcattcagccatctcctatttttctaccttat

SEQ ID NO: 274 - DNA, 200 bp, Amaranthus palmeri
tgaatggagctcacactcctctcttcctctactaatatacaacctgcctaatttgcacaatagctgctaatatcatagtagtatgagataatggctggatgtctcaattgttaccctagttttgacaactattttacgttggcatttcggtggcctggggccgtggactgagtcaccttaaaaattcatctgtgatatag

SEQ ID NO: 275 - DNA, 200 bp, Amaranthus palmeri
ctatatcacagatgaatttttaaggtgactcagtccacggccccaggccaccgaaatgccaacgtaaaatagttgtcaaaactagggtaacaattgagacatccagccattatctcatactactatgatattagcagctattgtgcaaattaggcaggttgtatattagtagaggaagagaggagtgtgagctccattca

SEQ ID NO: 276 - DNA, 200 bp, Amaranthus palmeri
ccttaaaaattcatctgtgatatagtttagaatcaattttgaaaatttaggcaggcctaaattttgataaagatagcatgatctaaagaatgcagctctaataaatttacataaaatttgatattaagtagtctctgtctaggcctgccttccgagcttgtatattaactgagcgcatgtttatttgaggaatagcatag

SEQ ID NO: 277 - DNA, 200 bp, Amaranthus palmeri
ctatgctattcctcaaataaacatgcgctcagttaatatacaagctcggaaggcaggcctagacagagactacttaatatcaaattttatgtaaatttattagagctgcattctttagatcatgctatctttatcaaaatttaggcctgcctaaattttcaaaattgattctaaactatatcacagatgaatttttaagg

SEQ ID NO: 278 - DNA, 200 bp, Amaranthus palmeri
catgtttatttgaggaatagcataggagtcatttttttgcatactaattagcatgtcaattttattccatttgctgagtactgtatgttctgcagacacttgttgacacaatgtgcaaacagcttggtgaagacgaactcaaactccagtgtgaggtgctgtccttgtcatacaaccagaaggggatcccttcattaggg

SEQ ID NO: 279 - DNA, 200 bp, Amaranthus palmeri
ccctaatgaagggatccccttctggttgtatgacaaggacagcacctcacactggagtttgagttcgtcttcaccaagctgtttgcacattgtgtcaacaagtgtctgcagaacatacagtactcagcaaatggaataaaattgacatgctaattagtatgcaaaaaaatgactcctatgctattcctcaaataaacatg

SEQ ID NO: 280 - DNA, 200 bp, Amaranthus palmeri
catgtggtggagatcctcaatcgctatctatgcaccatacatttcccgacgtatggaatgttgaaaaaaggtttggctctgtgtttgctggactaattcaatcaacattgttatctaagaaggaaaagggtggagggaaaatgcttctatcaagaagcctcgtgtacgcggttcattttcattccatggtggaatgcaga

SEQ ID NO: 281 - DNA, 200 bp, Amaranthus palmeri
tctgcattccaccatggaatgaaaatgaaccgcgtacacgaggcttcttgatagaagcattttccctccacccttttccttcttagataacaatgttgattgaattagtccagcaaacacagagccaaaccttttttcaacattccatacgtcgggaaatgtatggtgcatagatagcgattgaggatctccaccacatg

SEQ ID NO: 282 - DNA, 200 bp, Amaranthus palmeri
ttttcattccatggtggaatgcagacacttgttgacacaatgtgcaaacagcttggtgaagatgaactcaagctccagtgtgaggtgctgtccttgtcatacaaccagaaggggatcccttcattagggaattggtcagtctcttctatgtcaaataataccagtgaagatcaatcttatgatgctgtggttgtcactgc

SEQ ID NO: 283 - DNA, 200 bp, Amaranthus palmeri
gcagtgacaaccacagcatcataagattgatcttcactggtattatttgacatagaagagactgaccaattccctaatgaagggatccccttctggttgtatgacaaggacagcacctcacactggagcttgagttcatcttcaccaagctgtttgcacattgtgtcaacaagtgtctgcattccaccatggaatgaaaa

SEQ ID NO: 284 - DNA, 200 bp, Amaranthus palmeri
cttatgatgctgtggttgtcactgctccaattcgcaatgtcaaagaaatgaagattatgaaatttggaaatccattttcacttgactttattccagaggtgacttacgtacccctttccgttatgattactgcattcaagaaggataaagtgaagagacctctcgagggcttcggagttcttatcccgtctaaagagcaa

SEQ ID NO: 285 - DNA, 200 bp, Amaranthus palmeri
ttgctctttagacgggataagaactccgaagccctcgagaggtctcttcactttatccttcttgaatgcagtaatcataacggaaaggggtacgtaagtcacctctggaataaagtcaagtgaaaatggatttccaaatttcataatcttcatttctttgacattgcgaattggagcagtgacaaccacagcatcataag

SEQ ID NO: 286 - DNA, 200 bp, Amaranthus palmeri
agttcttatcccgtctaaagagcaacataatggactgaagactcttggtactttattttcgtctatgatgtttcctgatcgtgctccatctgatatgtgtctttttaccacatttgtcggaggaagcagaaatagaaaacttgcaaacgcttcaacggatgaattgaagcaaatagtttcttctgaccttcagcagctgt

SEQ ID NO: 287 - DNA, 200 bp, Amaranthus palmeri
acagctgctgaaggtcagaagaaactatttgcttcaattcatccgttgaagcgtttgcaagttttctatttctgcttcctccgacaaatgtggtaaaaagacacatatcagatggagcacgatcaggaaacatcatagacgaaaataaagtaccaagagtcttcagtccattatgttgctctttagacgggataagaact

SEQ ID NO: 288 - DNA, 200 bp, Amaranthus palmeri
gtttcttctgaccttcagcagctgttgggcactgaggacgaaccttcatttgtcaatcatctcttttggagcaatgcattcccgttgtatgggcacaattacgattctgttttgacagcaatagacaagatggaaaaggatcttcctggattttttatgcaggtaaccataagggtggactttcagtaggaaaagcgatg

SEQ ID NO: 289 - DNA, 200 bp, Amaranthus palmeri
catcgcttttcctactgaaagtccacccttatggttacctgcataaaaaatccaggaagatccttttccatcttgtctattgctgtcaaaacagaatcgtaattgtgcccatacaacgggaatgcattgctccaaaagagatgattgacaaatgaaggttcgtcctcagtgcccaacagctgctgaaggtcagaagaaac

SEQ ID NO: 290 - DNA, 200 bp, Amaranthus palmeri
ggggagcgggttgctggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctcaact

SEQ ID NO: 291 - DNA, 200 bp, Amaranthus palmeri
agttgagcttgagcttgtggaacaatggatatatgataattttcgaggtcttccgaagaagatgggggagcgggttggtgtataagcagaaaagcggaaagagatgtcggagtgcggcggacattgtagaatgctgctcgataacgccatggcactcatctctcttgcactctctctggttatccagcaacccgctcccc

SEQ ID NO: 292 - DNA, 200 bp, Amaranthus palmeri
ggtgtttatttgggcatggccttatgtgtgatgttggtaaattttgtggcttcgtccactaatctgatgtatcggatctgttaaagggagccctctcatcctatgcttatcaatgactttttcatatgcctatcaaacagatcagattggatcgggttcgagttcaggtcatatataaacatgtcagcaaacccttgacc

SEQ ID NO: 293 - DNA, 200 bp, Amaranthus palmeri
ggtcaagggtttgctgacatgtttatatatgacctgaactcgaacccgatccaatctgatctgtttgataggcatatgaaaaagtcattgataagcataggatgagagggctccctttaacagatccgatacatcagattagtggacgaagccacaaaatttaccaacatcacacataaggccatgcccaaataaacacc

SEQ ID NO: 294 - DNA, 200 bp, Amaranthus palmeri
taaacatgtcagcaaacccttgacccatacccaacccatttagttaattggcttgaaaatcacaaccttaattcgaccagcgacagatcaggttgacctgatttcgacccacttaacccatttataatttttttttcgatttaagttttttaacattgattaaatctaattttttaggctttaattttaattttatgttt

SEQ ID NO: 295 - DNA, 200 bp, Amaranthus palmeri
aaacataaaattaaaattaaagcctaaaaaattagatttaatcaatgttaaaaaacttaaatcgaaaaaaaaattataaatgggttaagtgggtcgaaatcaggtcaacctgatctgtcgctggtcgaattaaggttgtgattttcaagccaattaactaaatgggttgggtatgggtcaagggtttgctgacatgttta

SEQ ID NO: 296 - DNA, 200 bp, Amaranthus palmeri
aggctttaattttaattttatgtttttttgtttaatttgtatttactatgaaaaataagaaactattatatgaactgagtttagcttacacttattaatttaactcgaaattaacacatttaattaaatggttatatagggttttttagttttaaaatttcaacctgaacctaatctatttaataaaaagatcagatctg

SEQ ID NO: 297 - DNA, 200 bp, Amaranthus palmeri
cagatctgatctttttattaaatagattaggttcaggttgaaattttaaaactaaaaaaccctatataaccatttaattaaatgtgttaatttcgagttaaattaataagtgtaagctaaactcagttcatataatagtttcttatttttcatagtaaatacaaattaaacaaaaaaacataaaattaaaattaaagcct

SEQ ID NO: 298 - DNA, 200 bp, Amaranthus palmeri
ctatttaataaaaagatcagatctgatcaacccatataattaattgggtcaaaatctcaactcaaacccatttatttcgaattaaattcagatcaaattagcaggtcggatcaactagcgctaatttttcctctcaagttttttcatatgatgccccttgttttctttgaataaaattcaccaatttaaaatccctgccc

SEQ ID NO: 299 - DNA, 200 bp, Amaranthus palmeri
gggcagggattttaaattggtgaattttattcaaagaaaacaaggggcatcatatgaaaaaacttgagaggaaaaattagcgctagttgatccgacctgctaatttgatctgaatttaattcgaaataaatgggtttgagttgagattttgacccaattaattatatgggttgatcagatctgatctttttattaaatag

SEQ ID NO: 300 - DNA, 200 bp, Amaranthus palmeri
attcaccaatttaaaatccctgcccttgatccgttggtattggtatttggtaaagcacatatggtaaattctactccattgttatctgtagttttggttctaaaccccaaacaaatcctactcctagcaccactaatcctcattactttctgtttgctgtctttctctacattcctactaaattaagacctagatgcagt

SEQ ID NO: 301 - DNA, 200 bp, Amaranthus palmeri
actgcatctaggtcttaatttagtaggaatgtagagaaagacagcaaacagaaagtaatgaggattagtggtgctaggagtaggatttgtttggggtttagaaccaaaactacagataacaatggagtagaatttaccatatgtgctttaccaaataccaataccaacggatcaagggcagggattttaaattggtgaat

SEQ ID NO: 302 - DNA, 200 bp, Amaranthus palmeri
tactaaattaagacctagatgcagtgttattctgttcgaggttgccgaaaacggtacaatagttgcctaatttgcaattcatgtttgttcttgcgttttctacattgtttactctattggaacaaaggttgaactttcagcctttcagggagtattttgatttttctgtcaaattaccttgccagatttatttggctatt

SEQ ID NO: 303 - DNA, 200 bp, Amaranthus palmeri
aatagccaaataaatctggcaaggtaatttgacagaaaaatcaaaatactccctgaaaggctgaaagttcaacctttgttccaatagagtaaacaatgtagaaaacgcaagaacaaacatgaattgcaaattaggcaactattgtaccgttttcggcaacctcgaacagaataacactgcatctaggtcttaatttagta

SEQ ID NO: 304 - DNA, 200 bp, Amaranthus palmeri
accttgccagatttatttggctattttgattgtgtgtatttctttgtcccttgtttccatggggctaaactccttttggttaatcttaaacatttcttctaattttgaattgcagtggtatgaagtgttgtttaatatacaatcaatttttctgaactgggttaatgaagagaagcattgtagacatgaggaatgtgttc

SEQ ID NO: 305 - DNA, 200 bp, Amaranthus palmeri
gaacacattcctcatgtctacaatgcttctcttcattaacccagttcagaaaaattgattgtatattaaacaacacttcataccactgcaattcaaaattagaagaaatgtttaagattaaccaaaaggagtttagccccatggaaacaagggacaaagaaatacacacaatcaaaatagccaaataaatctggcaaggt

SEQ ID NO: 306 - DNA, 200 bp, Amaranthus palmeri
cattgtagacatgaggaatgtgttcaagcatctcaaaacaaccaaattaatcccaaatgggatcttcaactgtaatagaggtaaatcacatatattctcatttaatggttattgttttattttaaggatgttattatgttgttatcaatgatagaaataagagaagcttgagcattcaaatgtatctatcactcactggt

SEQ ID NO: 307 - DNA, 200 bp, Amaranthus palmeri
accagtgagtgatagatacatttgaatgctcaagcttctcttatttctatcattgataacaacataataacatccttaaaataaaacaataaccattaaatgagaatatatgtgatttacctctattacagttgaagatcccatttgggattaatttggttgttttgagatgcttgaacacattcctcatgtctacaatg

SEQ ID NO: 308 - DNA, 200 bp, Amaranthus palmeri
tcaaatgtatctatcactcactggttgtggacatctaaaatatggaccaagagttttcttcatttcttgtaccagaatttgcaaatgtatgattaaagtttaggttggagttgcaataaaatttcattaccccgacgctattaagtggctcacactgaggcggggtttgagggtcggatggtgcaaccttcaggagaggt

SEQ ID NO: 309 - DNA, 200 bp, Amaranthus palmeri
acctctcctgaaggttgcaccatccgaccctcaaaccccgcctcagtgtgagccacttaatagcgtcggggtaatgaaattttattgcaactccaacctaaactttaatcatacatttgcaaattctggtacaagaaatgaagaaaactcttggtccatattttagatgtccacaaccagtgagtgatagatacatttga

SEQ ID NO: 310 - DNA, 200 bp, Amaranthus palmeri
ggatggtgcaaccttcaggagaggttctaagcattttcaacatgttcaaccgcagagggtcccgtaaaattggaggcttcaatattaaattatgtagtatgtgttaagtgtttaaagatataaaaatgttaatgaatacataatttttaaaattgcacagggctttcaaagaaatttttgattttgctccgcccatggca

SEQ ID NO: 311 - DNA, 200 bp, Amaranthus palmeri
tgccatgggcggagcaaaatcaaaaatttctttgaaagccctgtgcaattttaaaaattatgtattcattaacatttttatatctttaaacacttaacacatactacataatttaatattgaagcctccaattttacgggaccctctgcggttgaacatgttgaaaatgcttagaacctctcctgaaggttgcaccatcc

SEQ ID NO: 312 - DNA, 200 bp, Amaranthus palmeri
ttttgattttgctccgcccatggcaacctttggcaaatctggatagaattagagaaatttacttttatgtatgtataatctgatgaatgaatgaatgaacaatgaagttcatttctgagtcaatgacctatatactatcgaggtttcgttaaataggatatataaataaaattagagacatcttttatccctaatgttgt

SEQ ID NO: 313 - DNA, 200 bp, Amaranthus palmeri
acaacattagggataaaagatgtctctaattttatttatatatcctatttaacgaaacctcgatagtatataggtcattgactcagaaatgaacttcattgttcattcattcattcatcagattatacatacataaaagtaaatttctctaattctatccagatttgccaaaggttgccatgggcggagcaaaatcaaaa

SEQ ID NO: 314 - DNA, 200 bp, Amaranthus palmeri
agacatcttttatccctaatgttgtctgttttcttttctgggcgagactgtttttggagaaaaacgttatgttgaatgcttgatttactcagaactgatgcaaacagatggataaaaaatggtgttttcctagtgtttatgtttcataaaaggatttcaaattccaatcgtatgaagtttgaaatactgctttttgtttt

SEQ ID NO: 315 - DNA, 200 bp, Amaranthus palmeri
aaaacaaaaagcagtatttcaaacttcatacgattggaatttgaaatccttttatgaaacataaacactaggaaaacaccattttttatccatctgtttgcatcagttctgagtaaatcaagcattcaacataacgtttttctccaaaaacagtctcgcccagaaaagaaaacagacaacattagggataaaagatgtct

SEQ ID NO: 316 - DNA, 200 bp, Amaranthus palmeri
agtttgaaatactgctttttgtttttgtagcttcgtgttttgctttccttcactcttcaccagggaacgttgttgaagtttgttccaagaagcaagaagtcgtaattgcaatcgggagcaatgttggtgacagattagaaaatttcaaccaagctctgcaacaaatgaagaaattaggcatagacatcacaaggcatggt

SEQ ID NO: 317 - DNA, 200 bp, Amaranthus palmeri
accatgccttgtgatgtctatgcctaatttcttcatttgttgcagagcttggttgaaattttctaatctgtcaccaacattgctcccgattgcaattacgacttcttgcttcttggaacaaacttcaacaacgttccctggtgaagagtgaaggaaagcaaaacacgaagctacaaaaacaaaaagcagtatttcaaact

SEQ ID NO: 318 - DNA, 200 bp, Amaranthus palmeri
aggcatagacatcacaaggcatggttgtttatatgagacggaacctgcatacgtgactgatcaaccgaagtttcttaactctgctttaagaggctttacaagacttggacctcatgaattattaggggtattgaagaaaattgagaaggatatgggtagaaccaagggaataaggtatggtcctaggccaattgacttgg

SEQ ID NO: 319 - DNA, 200 bp, Amaranthus palmeri
ccaagtcaattggcctaggaccataccttattcccttggttctacccatatccttctcaattttcttcaatacccctaataattcatgaggtccaagtcttgtaaagcctcttaaagcagagttaagaaacttcggttgatcagtcacgtatgcaggttccgtctcatataaacaaccatgccttgtgatgtctatgcct

SEQ ID NO: 320 - DNA, 200 bp, Amaranthus palmeri
tatggtcctaggccaattgacttggacatactattttatgggaagtttagggtgagctctgagagcctcactatcccccatgaaaggatatgggaaagaccatttgtgatggcaccattgattgattgtattgggtctgatgtagaaaatgacactatttgtacgtggcattcattatcaaatttttcgggtggaatctt

SEQ ID NO: 321 - DNA, 200 bp, Amaranthus palmeri
aagattccacccgaaaaatttgataatgaatgccacgtacaaatagtgtcattttctacatcagacccaatacaatcaatcaatggtgccatcacaaatggtctttcccatatcctttcatgggggatagtgaggctctcagagctcaccctaaacttcccataaaatagtatgtccaagtcaattggcctaggaccata

SEQ ID NO: 322 - DNA, 200 bp, Amaranthus palmeri
tatcaaatttttcgggtggaatctttgaagcatggggtaaactcggtggaagctccctaatcgggaaggatggaatgaaaagggttttgcccgttggaaatctcttatgggattggtctcataaaacctctgttatgggagtcttgaacttgactcctgatagctttagtgatggcggaagttttcaatctgtcaatact

SEQ ID NO: 323 - DNA, 200 bp, Amaranthus palmeri
agtattgacagattgaaaacttccgccatcactaaagctatcaggagtcaagttcaagactcccataacagaggttttatgagaccaatcccataagagatttccaacgggcaaaacccttttcattccatccttcccgattagggagcttccaccgagtttaccccatgcttcaaagattccacccgaaaaatttgata

SEQ ID NO: 324 - DNA, 200 bp, Amaranthus palmeri
cggaagttttcaatctgtcaatactgcggttgctaaggttcgtcagatgatctcagatggggcagatataattgacatcggggcacaatcaaccagacccatggcaactagaatttcggctgaagaagagctagcaagagtagtacctgtattagaagctgtcaaggatttgatcgaggaagaaggaagaatcttgtcag

SEQ ID NO: 325 - DNA, 200 bp, Amaranthus palmeri
ctgacaagattcttccttcttcctcgatcaaatccttgacagcttctaatacaggtactactcttgctagctcttcttcagccgaaattctagttgccatgggtctggttgattgtgccccgatgtcaattatatctgccccatctgagatcatctgacgaaccttagcaaccgcagtattgacagattgaaaacttccg

SEQ ID NO: 326 - DNA, 200 bp, Amaranthus palmeri
gaggaagaaggaagaatcttgtcagtggatacgttttattctaaagttgctttggaggccgtcaagaagggggcacacattgtgaatgatgtctctagtggtaaactcgattccgagatgtttaatgttgttgcggaccttaaagttccttatatagcaatgcacatgcgaggagatccgacttcaatgcaaaactctga

SEQ ID NO: 327 - DNA, 200 bp, Amaranthus palmeri
tcagagttttgcattgaagtcggatctcctcgcatgtgcattgctatataaggaactttaaggtccgcaacaacattaaacatctcggaatcgagtttaccactagagacatcattcacaatgtgtgcccccttcttgacggcctccaaagcaactttagaataaaacgtatccactgacaagattcttccttcttcctc

SEQ ID NO: 328 - DNA, 200 bp, Amaranthus palmeri
atccgacttcaatgcaaaactctgagaacttgacctacaatgatgtttgtaagcaagtggcttcggagttgagttctagggtcatagatgcagaattatcgggaattcctgcttggaggatagttattgatcccggcatcggattttctaagaatacgaatcaaaatttggaaattcttagtggtttacaaaagatacgg

SEQ ID NO: 329 - DNA, 200 bp, Amaranthus palmeri
ccgtatcttttgtaaaccactaagaatttccaaattttgattcgtattcttagaaaatccgatgccgggatcaataactatcctccaagcaggaattcccgataattctgcatctatgaccctagaactcaactccgaagccacttgcttacaaacatcattgtaggtcaagttctcagagttttgcattgaagtcggat

SEQ ID NO: 330 - DNA, 200 bp, Amaranthus palmeri
tcttagtggtttacaaaagatacgggaagagatagctaagaagagtttggcggtggctcattgccccttgctaattggaccttcaagaaagaggtttctgggcgagatttgtgagcgccctgtagcagctgacagggatcctgctaccattgcttctataactgctggagttttaggtggtgcaaacattgtaagagtac

SEQ ID NO: 331 - DNA, 200 bp, Amaranthus palmeri
gtactcttacaatgtttgcaccacctaaaactccagcagttatagaagcaatggtagcaggatccctgtcagctgctacagggcgctcacaaatctcgcccagaaacctctttcttgaaggtccaattagcaaggggcaatgagccaccgccaaactcttcttagctatctcttcccgtatcttttgtaaaccactaaga

SEQ ID NO: 332 - DNA, 200 bp, Amaranthus palmeri
ggtggtgcaaacattgtaagagtacataatgttagggataaccttgatgctgtcaagttatgtgatgccatactcggaaaaactgattaactgcttgtttgtaccaccttgtgaatgatgtctagtggaaggttcgattgggattatgatgaagtccgttagtttgctcgaaagaagagctttagcccgtaaggttatag

SEQ ID NO: 333 - DNA, 200 bp, Amaranthus palmeri
ctataaccttacgggctaaagctcttctttcgagcaaactaacggacttcatcataatcccaatcgaaccttccactagacatcattcacaaggtggtacaaacaagcagttaatcagtttttccgagtatggcatcacataacttgacagcatcaaggttatccctaacattatgtactcttacaatgtttgcaccacc

SEQ ID NO: 334 - DNA, 200 bp, Amaranthus palmeri
agagctttagcccgtaaggttatagttcttacagatgtagaatcattggctatttgcctatttctgcttagaagatcatagcattgatccagactttggattccatgtagaattatgttgcgactcatggtcgaattggccctttgaggaattgttgaagttccttgagtctatggttcaatcggctcggttcgatgaag

SEQ ID NO: 335 - DNA, 200 bp, Amaranthus palmeri
cttcatcgaaccgagccgattgaaccatagactcaaggaacttcaacaattcctcaaagggccaattcgaccatgagtcgcaacataattctacatggaatccaaagtctggatcaatgctatgatcttctaagcagaaataggcaaatagccaatgattctacatctgtaagaactataaccttacgggctaaagctct

SEQ ID NO: 336 - DNA, 200 bp, Amaranthus palmeri
gttcaatcggctcggttcgatgaaggttggactgtgtcgagacaagatgggtcaaagagaccaatggacaagaagtcgaccttgggcaagcttgatcaagttacttggacgagcagataacagcaggctctggcgagcattagacatacatatcatttgttttttgaagtcagatctgcaatcaatcagttgcaatggac

SEQ ID NO: 337 - DNA, 200 bp, Amaranthus palmeri
gtccattgcaactgattgattgcagatctgacttcaaaaaacaaatgatatgtatgtctaatgctcgccagagcctgctgttatctgctcgtccaagtaacttgatcaagcttgcccaaggtcgacttcttgtccattggtctctttgacccatcttgtctcgacacagtccaaccttcatcgaaccgagccgattgaac

SEQ ID NO: 338 - DNA, 200 bp, Amaranthus palmeri
ctgcaatcaatcagttgcaatggacagaccatatacggttgttagttgttcctgtcactctttgagttgaattagatcatgcaaacactgtaagagtcttgattttgtgaagctatgtgatactgtacttctcaaaatgaaatctttgatatgatgttagcttcaagagttgtttttccccccctcacattctgttctat

SEQ ID NO: 339 - DNA, 200 bp, Amaranthus palmeri
atagaacagaatgtgagggggggaaaaacaactcttgaagctaacatcatatcaaagatttcattttgagaagtacagtatcacatagcttcacaaaatcaagactcttacagtgtttgcatgatctaattcaactcaaagagtgacaggaacaactaacaaccgtatatggtctgtccattgcaactgattgattgcag

SEQ ID NO: 340 - DNA, 200 bp, Amaranthus palmeri
ttccccccctcacattctgttctatgttgtattgttgtgtgctttttggaattgtattcctgtaattagaattattcctgcaaaatggtattcctttatatcatcaaaggagtttttgtacttctaatcattgatctttagatgcaaaactgaattaatacaagtgttcttgatgaaggcttattgaagaactcactttt

SEQ ID NO: 341 - DNA, 200 bp, Amaranthus palmeri
aaaagtgagttcttcaataagccttcatcaagaacacttgtattaattcagttttgcatctaaagatcaatgattagaagtacaaaaactcctttgatgatataaaggaataccattttgcaggaataattctaattacaggaatacaattccaaaaagcacacaacaatacaacatagaacagaatgtgagggggggaa

SEQ ID NO: 342 - DNA, 200 bp, Amaranthus palmeri
aaggcttattgaagaactcactttttatttatgtctaaacttgttaaagatgttctgcttccgcccttgccacgggatgtcgggattgactaagggtggtaatcgagggattcctatgcttgaattgactcgtttaagattttgcgttgattttaagtcaaatgttttgctaagcataaactattctagctcgacttgaa

SEQ ID NO: 343 - DNA, 200 bp, Amaranthus palmeri
ttcaagtcgagctagaatagtttatgcttagcaaaacatttgacttaaaatcaacgcaaaatcttaaacgagtcaattcaagcataggaatccctcgattaccacccttagtcaatcccgacatcccgtggcaagggcggaagcagaacatctttaacaagtttagacataaataaaaagtgagttcttcaataagcctt

SEQ ID NO: 344 - DNA, 200 bp, Amaranthus palmeri
ataaactattctagctcgacttgaataatgaagttttcgagtcaagtccgagctgttctgtaagtttatgtatcttgaagcttcttagttcttacttcttatccttatttgtttgacacattgaaccgcgttgatgcttgcttgactcaacccgttaaagtcttgaattcatcacgaattcgagtcgagcaagtttaaac

SEQ ID NO: 345 - DNA, 200 bp, Amaranthus palmeri
gtttaaacttgctcgactcgaattcgtgatgaattcaagactttaacgggttgagtcaagcaagcatcaacgcggttcaatgtgtcaaacaaataaggataagaagtaagaactaagaagcttcaagatacataaacttacagaacagctcggacttgactcgaaaacttcattattcaagtcgagctagaatagtttat

SEQ ID NO: 346 - DNA, 200 bp, Amaranthus palmeri
gaattcgagtcgagcaagtttaaacccaacattaactaagctctcgaggcttaatgaggcaggggtagctcaagtttgttattcaagcaacttaccatagtattcttttaaaaggcatatagtcagttagttatttgttaatttcagtagaacgaaagaagtacattattaaacttggccattgatgcttgagctagaga

SEQ ID NO: 347 - DNA, 200 bp, Amaranthus palmeri
tctctagctcaagcatcaatggccaagtttaataatgtacttctttcgttctactgaaattaacaaataactaactgactatatgccttttaaaagaatactatggtaagttgcttgaataacaaacttgagctacccctgcctcattaagcctcgagagcttagttaatgttgggtttaaacttgctcgactcgaattc

SEQ ID NO: 348 - DNA, 200 bp, Amaranthus palmeri
tggccattgatgcttgagctagagagcttcggttgtgatcgaaacgaatcctgatttcgctcttgatctttgatgtgaagtgacaaggccttcataaaactcctttattcttcagcagtgcatacaaaaatcatgtgtgcccagctcctagctcacataccgcgtttttcccctaatctagtgtggtcaaataaaaacag

SEQ ID NO: 349 - DNA, 200 bp, Amaranthus palmeri
ctgtttttatttgaccacactagattaggggaaaaacgcggtatgtgagctaggagctgggcacacatgatttttgtatgcactgctgaagaataaaggagttttatgaaggccttgtcacttcacatcaaagatcaagagcgaaatcaggattcgtttcgatcacaaccgaagctctctagctcaagcatcaatggcca

SEQ ID NO: 350 - DNA, 200 bp, Amaranthus palmeri
atctagtgtggtcaaataaaaacagcaagatgtgttgatgtcatgtgcaatagtaattatcaggtgaagtaatgcaatatgtagccagtcacctcatatcaaaaaaatgttgggaggaaaacgtattcgttcatcactaaacctgtgtttatacatctaactgatcgatcagggtttcaaaatccaaattaatacaatgg

SEQ ID NO: 351 - DNA, 200 bp, Amaranthus palmeri
ccattgtattaatttggattttgaaaccctgatcgatcagttagatgtataaacacaggtttagtgatgaacgaatacgttttcctcccaacatttttttgatatgaggtgactggctacatattgcattacttcacctgataattactattgcacatgacatcaacacatcttgctgtttttatttgaccacactagat

SEQ ID NO: 352 - DNA, 200 bp, Amaranthus palmeri
ttcaaaatccaaattaatacaatggcatttgacgaagatatccagaacacatcccccttgtttctgctagataatcaactattctgattctgctgtaatacctcagcttcggccctagccatgggatcgtcctctttttctccttcacgctcctcggccagtttctttctgtgcagttcttcagcagcttctattgaagc

SEQ ID NO: 353 - DNA, 200 bp, Amaranthus palmeri
gcttcaatagaagctgctgaagaactgcacagaaagaaactggccgaggagcgtgaaggagaaaaagaggacgatcccatggctagggccgaagctgaggtattacagcagaatcagaatagttgattatctagcagaaacaagggggatgtgttctggatatcttcgtcaaatgccattgtattaatttggattttgaa

SEQ ID NO: 354 - DNA, 200 bp, Amaranthus palmeri
gttcttcagcagcttctattgaagctttgttctcggcctgaagacgctgcatttcctcttccatttgctgcctctcaaaccatgtatcagcatccgcccaaactgcagacaagtatacaaaagttaaataacgaaagtcttcaaaactgcagatccagtgaacaaagtcattgttgccaatgcccatgcaaaccgcaaaa

SEQ ID NO: 355 - DNA, 200 bp, Amaranthus palmeri
ttttgcggtttgcatgggcattggcaacaatgactttgttcactggatctgcagttttgaagactttcgttatttaacttttgtatacttgtctgcagtttgggcggatgctgatacatggtttgagaggcagcaaatggaagaggaaatgcagcgtcttcaggccgagaacaaagcttcaatagaagctgctgaagaac

SEQ ID NO: 356 - DNA, 200 bp, Amaranthus palmeri
gccaatgcccatgcaaaccgcaaaacagcagggcaaaagaacacaacattgcagcataaagagcaagttcagtgatctacagttactacaaaatttaggtttgggataccagcatgtcaatatgaatgaatttgctaatacatgtaacccaagaactataagtctataactaacaattaagaaaagaaaaccagaagttc

SEQ ID NO: 357 - DNA, 200 bp, Amaranthus palmeri
gaacttctggttttcttttcttaattgttagttatagacttatagttcttgggttacatgtattagcaaattcattcatattgacatgctggtatcccaaacctaaattttgtagtaactgtagatcactgaacttgctctttatgctgcaatgttgtgttcttttgccctgctgttttgcggtttgcatgggcattggc

SEQ ID NO: 358 - DNA, 200 bp, Amaranthus palmeri
attaagaaaagaaaaccagaagttccctaccactggagtattagcaaggtaacgactgcctgctgataagaattattggcctggaagtctggaactatgtgatgatcaacatgtgttgctattctaggtaaaactaatctatcataatataattaaactacaggccccagaattggggtcctgagctattgatcatgctg

SEQ ID NO: 359 - DNA, 200 bp, Amaranthus palmeri
cagcatgatcaatagctcaggaccccaattctggggcctgtagtttaattatattatgatagattagttttacctagaatagcaacacatgttgatcatcacatagttccagacttccaggccaataattcttatcagcaggcagtcgttaccttgctaatactccagtggtagggaacttctggttttcttttcttaat

SEQ ID NO: 360 - DNA, 200 bp, Amaranthus palmeri
gggtcctgagctattgatcatgctgttaaagcaaaagagttgggctgaatgagactagcaattaaaagcataggatacactgaacaatgcttccccctccccatccaaacacgtaggttttagttacacaatagtggcttgagctagaaaaccataaggatatcatagtggacacatcatagttaagttttacataaata

SEQ ID NO: 361 - DNA, 200 bp, Amaranthus palmeri
tatttatgtaaaacttaactatgatgtgtccactatgatatccttatggttttctagctcaagccactattgtgtaactaaaacctacgtgtttggatggggagggggaagcattgttcagtgtatcctatgcttttaattgctagtctcattcagcccaactcttttgctttaacagcatgatcaatagctcaggaccc

SEQ ID NO: 362 - DNA, 200 bp, Amaranthus palmeri
atcatagttaagttttacataaatataccttatacatgtataagcaatacatttccaggttgataggtcagttttatgtctatattgatcgccattctattatgagggaattatattccaataatgggtaatcatcaatgagcagtatttataggaatttattgatagcgtttctattattaggatatagaaattccaat

SEQ ID NO: 363 - DNA, 200 bp, Amaranthus palmeri
attggaatttctatatcctaataatagaaacgctatcaataaattcctataaatactgctcattgatgattacccattattggaatataattccctcataatagaatggcgatcaatatagacataaaactgacctatcaacctggaaatgtattgcttatacatgtataaggtatatttatgtaaaacttaactatgat

SEQ ID NO: 364 - DNA, 200 bp, Amaranthus palmeri
taaaaatgacgttaaatatattttatttttattttgttaatttatgtgttttaattataaagtattaaaaaatacgatgattaataagatactgctacatagacaacttaacctctcaaattggtcaaacccttaaacttaacggttaactaacgttttccattaagtgatagtcatttgcagagatttatattagatta

SEQ ID NO: 365 - DNA, 200 bp, Amaranthus palmeri
taatctaatataaatctctgcaaatgactatcacttaatggaaaacgttagttaaccgttaagtttaagggtttgaccaatttgagaggttaagttgtctatgtagcagtatcttattaatcatcgtattttttaatactttataattaaaacacataaattaacaaaataaaaataaaatatatttaacgtcattttta

SEQ ID NO: 366 - DNA, 200 bp, Amaranthus palmeri
atttgcagagatttatattagattaggtagttttttgcaaaaaaaaaaattacattaggtagttttttgcaaatagacctatagattaggcagtttcttataatttttccttcttattatttgttgtttcagatatggcttcaagaatgaagtttggtaaccaaacttttcaaatttgaagtgagggttggagctctggt

SEQ ID NO: 367 - DNA, 200 bp, Amaranthus palmeri
accagagctccaaccctcacttcaaatttgaaaagtttggttaccaaacttcattcttgaagccatatctgaaacaacaaataataagaaggaaaaattataagaaactgcctaatctataggtctatttgcaaaaaactacctaatgtaatttttttttttgcaaaaaactacctaatctaatataaatctctgcaaat

SEQ ID NO: 368 - DNA, 200 bp, Amaranthus palmeri
ttgaagtgagggttggagctctggtgttggaagccttttttgtaacaccccaaaaattttaggcaaactttatacgtttgtttatccaaaaaaaaaataataaataaataaaaaaaaaaaaattcttaaagtagaaccacttaagggtcggaggtctaggtaataattttggagtgataaatgtaaagattgaagagttt

SEQ ID NO: 369 - DNA, 200 bp, Amaranthus palmeri
aaactcttcaatctttacatttatcactccaaaattattacctagacctccgacccttaagtggttctactttaagaatttttttttttttatttatttattattttttttttggataaacaaacgtataaagtttgcctaaaatttttggggtgttacaaaaaaggcttccaacaccagagctccaaccctcacttcaa

SEQ ID NO: 370 - DNA, 200 bp, Amaranthus palmeri
gataaatgtaaagattgaagagtttgtaactcataccattagttcactcatttacctcaatttatgattataattaagtattacaaaaaaaaggggaaacaatcacttcatattccaaaggtgaagcttttaatagtgaaggaaaaggatttcttaagcaatacagtattaaacgtaaactaaaaaaaataataaatcat

SEQ ID NO: 371 - DNA, 200 bp, Amaranthus palmeri
atgatttattattttttttagtttacgtttaatactgtattgcttaagaaatccttttccttcactattaaaagcttcacctttggaatatgaagtgattgtttccccttttttttgtaatacttaattataatcataaattgaggtaaatgagtgaactaatggtatgagttacaaactcttcaatctttacatttatc

SEQ ID NO: 372 - DNA, 200 bp, Amaranthus palmeri
taaactaaaaaaaataataaatcatatcttaattttgagaagttttattcttaatttgtttatccctatcaatactaagcttgggataataaacaaagggttatcaaggttggaggatttttaatttcgagattatatacttgaattgaagaaattttatgttcaagagaattatattagaggaatatttgtaaggctat

SEQ ID NO: 373 - DNA, 200 bp, Amaranthus palmeri
atagccttacaaatattcctctaatataattctcttgaacataaaatttcttcaattcaagtatataatctcgaaattaaaaatcctccaaccttgataaccctttgtttattatcccaagcttagtattgatagggataaacaaattaagaataaaacttctcaaaattaagatatgatttattattttttttagttta

SEQ ID NO: 374 - DNA, 200 bp, Amaranthus palmeri
attagaggaatatttgtaaggctattatctacaattcttcatatttctctaattgaaatatatataaaggtaactagtttaccctctcttttcttaattcatatacattgttattttttttattatatggaaaatataaaacggaaaaaaaaatgtaaattaaacttatcttagttttgagataattgatgttatatagt

SEQ ID NO: 375 - DNA, 200 bp, Amaranthus palmeri
actatataacatcaattatctcaaaactaagataagtttaatttacatttttttttccgttttatattttccatataataaaaaaaataacaatgtatatgaattaagaaaagagagggtaaactagttacctttatatatatttcaattagagaaatatgaagaattgtagataatagccttacaaatattcctctaat

SEQ ID NO: 376 - DNA, 200 bp, Amaranthus palmeri
tttgagataattgatgttatatagtcttataatgttgattaacgttgaaaattgaattacaaaactaaataatttaaacatatgatttgttaacttctactaattaaatcttggttaggggtgatttagttgatttgagaaatatccaaataaataattagattagtttggtgaaataatatttttttttgacttcgaaa

SEQ ID NO: 377 - DNA, 200 bp, Amaranthus palmeri
tttcgaagtcaaaaaaaaatattatttcaccaaactaatctaattatttatttggatatttctcaaatcaactaaatcacccctaaccaagatttaattagtagaagttaacaaatcatatgtttaaattatttagttttgtaattcaattttcaacgttaatcaacattataagactatataacatcaattatctcaaa

SEQ ID NO: 378 - DNA, 200 bp, Amaranthus palmeri
ataatatttttttttgacttcgaaaacaatgggttaatttggcacactaatttggaatgtacaaataagttcattagagtagagcttcttaaattatgttttggtatagttaaaagtgatgttaatgtatggttaatattttataaatattttatatattttgtttagttgaattggccacttaatgaatttgtacattg

SEQ ID NO: 379 - DNA, 200 bp, Amaranthus palmeri
caatgtacaaattcattaagtggccaattcaactaaacaaaatatataaaatatttataaaatattaaccatacattaacatcacttttaactataccaaaacataatttaagaagctctactctaatgaacttatttgtacattccaaattagtgtgccaaattaacccattgttttcgaagtcaaaaaaaaatattat

SEQ ID NO: 380 - DNA, 200 bp, Amaranthus palmeri
ggccacttaatgaatttgtacattgctgttaaaaaaaaagagaggatattaatcgtttggtacaacagcataattgagcaaatcataaatctgccaaaattcaagtaattaaaaataattatcaattaacagttatacaagtgtatgtatgtggcattagcctaattgattgcgcaaggactaaataattacttattcag

SEQ ID NO: 381 - DNA, 200 bp, Amaranthus palmeri
ctgaataagtaattatttagtccttgcgcaatcaattaggctaatgccacatacatacacttgtataactgttaattgataattatttttaattacttgaattttggcagatttatgatttgctcaattatgctgttgtaccaaacgattaatatcctctctttttttttaacagcaatgtacaaattcattaagtggcc

SEQ ID NO: 382 - DNA, 200 bp, Amaranthus palmeri
aaggactaaataattacttattcaggtaatttagtattttatccaggttaattagaggttagttgagttgattatgatcaatattttggttaaatataaattttggcaaagaaaaatgagtattaatattgtatttattttgagactcgacaatttttagttgaattgttactttctaagatgttaagagtgttgttgac

SEQ ID NO: 383 - DNA, 200 bp, Amaranthus palmeri
gtcaacaacactcttaacatcttagaaagtaacaattcaactaaaaattgtcgagtctcaaaataaatacaatattaatactcatttttctttgccaaaatttatatttaaccaaaatattgatcataatcaactcaactaacctctaattaacctggataaaatactaaattacctgaataagtaattatttagtcctt

SEQ ID NO: 384 - DNA, 200 bp, Amaranthus palmeri
tcaaattggtcaaacccttaaacgatcaactaacgttttccattaagtggtagtcatttgcaaagaaatatattatattatgtagttttttacaaaaaaagaaaactacattaggcagttttttgcaaatagacctattagattttttttttaatttttccttcttgttatttgctgtttctaatgtggcttcaaaaatg

SEQ ID NO: 385 - DNA, 200 bp, Amaranthus palmeri
catttttgaagccacattagaaacagcaaataacaagaaggaaaaattaaaaaaaaaatctaataggtctatttgcaaaaaactgcctaatgtagttttctttttttgtaaaaaactacataatataatatatttctttgcaaatgactaccacttaatggaaaacgttagttgatcgtttaagggtttgaccaatttga

SEQ ID NO: 386 - DNA, 200 bp, Amaranthus palmeri
tgtttctaatgtggcttcaaaaatgaagtttggtaaccaaacttttcaaatttgaagtgagggttgggaagccttttggtgtcccttctattaagagttggggcctcacaatcactagataacgtgcctttctctcatgccttacctttctaattcttagaatagaaaaaagacggtgaattttttatacgctgtatgat

SEQ ID NO: 387 - DNA, 200 bp, Amaranthus palmeri
atcatacagcgtataaaaaattcaccgtcttttttctattctaagaattagaaaggtaaggcatgagagaaaggcacgttatctagtgattgtgaggccccaactcttaatagaagggacaccaaaaggcttcccaaccctcacttcaaatttgaaaagtttggttaccaaacttcatttttgaagccacattagaaaca

SEQ ID NO: 388 - DNA, 200 bp, Amaranthus palmeri
gtgaattttttatacgctgtatgattacattttttgaaatctctccgatcatcttgatcatgggatggaattgttcgtgcacatgttttttaagaatggaatctaagcatagtgtattagagagaatgagtgaaagttagtggaaagaaaaattgagttggagaataaaataaaaaacaagtgggtaatagaaataagtg

SEQ ID NO: 389 - DNA, 200 bp, Amaranthus palmeri
cacttatttctattacccacttgttttttattttattctccaactcaatttttctttccactaactttcactcattctctctaatacactatgcttagattccattcttaaaaaacatgtgcacgaacaattccatcccatgatcaagatgatcggagagatttcaaaaaatgtaatcatacagcgtataaaaaattcac

SEQ ID NO: 390 - DNA, 200 bp, Amaranthus palmeri
aacaagtgggtaatagaaataagtggttacgatgaagagggtgtataaatttgtagataagattaaaaggggtgggagtaccattgttataaaagaaaagagtgcaaaatccgttggacgaatttaaataaaaagtggtgtaaaatgaaaggaacgacaagaatatgattttcccagctataacactgtcacaaatgtaa

SEQ ID NO: 391 - DNA, 200 bp, Amaranthus palmeri
ttacatttgtgacagtgttatagctgggaaaatcatattcttgtcgttcctttcattttacaccactttttatttaaattcgtccaacggattttgcactcttttcttttataacaatggtactcccaccccttttaatcttatctacaaatttatacaccctcttcatcgtaaccacttatttctattacccacttgtt

SEQ ID NO: 392 - DNA, 200 bp, Amaranthus palmeri
tcagatatgtcttcataaagtattcaagtttgagcatgaaaatccacatgtacatgacatgagtatgcaaatgcaagtaatacaaacacataggcaaaagagatgatgtaatcactattcggtaatcgctcgcgcacaaatagtagctcactatatgaatgagatgagaaaatttcaattgttgtaaaggcgagttcctt

SEQ ID NO: 393 - DNA, 200 bp, Amaranthus palmeri
aaggaactcgcctttacaacaattgaaattttctcatctcattcatatagtgagctactatttgtgcgcgagcgattaccgaatagtgattacatcatctcttttgcctatgtgtttgtattacttgcatttgcatactcatgtcatgtacatgtggattttcatgctcaaacttgaatactttatgaagacatatctga

SEQ ID NO: 394 - DNA, 200 bp, Amaranthus palmeri
caattgttgtaaaggcgagttccttatgttttagtccaacagtgttttgtaacctttgtgtaattttttatatgaagcacaagagcaggtctcaaataagtacaggagataaatgaaactagaaataaaagtgttcaatatacttggacatagtcacatagttaatgccaaaatccatctttctgataagttggggccac

SEQ ID NO: 395 - DNA, 200 bp, Amaranthus palmeri
gtggccccaacttatcagaaagatggattttggcattaactatgtgactatgtccaagtatattgaacacttttatttctagtttcatttatctcctgtacttatttgagacctgctcttgtgcttcatataaaaaattacacaaaggttacaaaacactgttggactaaaacataaggaactcgcctttacaacaattg

SEQ ID NO: 396 - DNA, 200 bp, Amaranthus palmeri
catctttctgataagttggggccacttatacactatactaacatgagcctggaaagaaatagccagcaggaccgcaggtatagattgttagctaggaaaaccacaaaaccatactccctccatattaaaatgacattaacaagtgattagtaatgtaataacctacttacatattctaacaagtgattaatttcaatagt

SEQ ID NO: 397 - DNA, 200 bp, Amaranthus palmeri
actattgaaattaatcacttgttagaatatgtaagtaggttattacattactaatcacttgttaatgtcattttaatatggagggagtatggttttgtggttttcctagctaacaatctatacctgcggtcctgctggctatttctttccaggctcatgttagtatagtgtataagtggccccaacttatcagaaagatg

SEQ ID NO: 398 - DNA, 200 bp, Amaranthus palmeri
ctaacaagtgattaatttcaatagtattccgacaaaatgtagctttaataattatcttccatctcatcaaatttgtttgggaaatttgtaacactgatcaatgactctagcacaaggaatagctaaaattatcatcatcatcatgatcatcttgactagtgtatcccactcataaggaaactatgatcagggtctggaaa

SEQ ID NO: 399 - DNA, 200 bp, Amaranthus palmeri
tttccagaccctgatcatagtttccttatgagtgggatacactagtcaagatgatcatgatgatgatgataattttagctattccttgtgctagagtcattgatcagtgttacaaatttcccaaacaaatttgatgagatggaagataattattaaagctacattttgtcggaatactattgaaattaatcacttgttag

SEQ ID NO: 400 - DNA, 200 bp, Amaranthus palmeri
ggaaactatgatcagggtctggaaagggaaggaaggcgacaaatcataccataaagggagtttagaggtaatgaatacctaaatcctgatcctaaaacaattgatcttccccattaccacgccaatatcaacccacaaagcatccggggaaagtcaaacaaagggaaaaatcacaattgaaatatcctagtttcaagttt

SEQ ID NO: 401 - DNA, 200 bp, Amaranthus palmeri
aaacttgaaactaggatatttcaattgtgatttttccctttgtttgactttccccggatgctttgtgggttgatattggcgtggtaatggggaagatcaattgttttaggatcaggatttaggtattcattacctctaaactccctttatggtatgatttgtcgccttccttccctttccagaccctgatcatagtttcc

SEQ ID NO: 402 - DNA, 200 bp, Amaranthus palmeri
attgaaatatcctagtttcaagtttcaaccaattgggtaccatttacccatgttcaagtgtagcaaaaaccctaatatagcatcttaatacagctccagtaaacattatgcagtcttaatctgaagctactataccaaaacgactaacatttaacaaatgccattccaccattaaaaaaaagggtgttttagcggtaatg

SEQ ID NO: 403 - DNA, 200 bp, Amaranthus palmeri
cattaccgctaaaacacccttttttttaatggtggaatggcatttgttaaatgttagtcgttttggtatagtagcttcagattaagactgcataatgtttactggagctgtattaagatgctatattagggtttttgctacacttgaacatgggtaaatggtacccaattggttgaaacttgaaactaggatatttcaat

SEQ ID NO: 404 - DNA, 200 bp, Amaranthus palmeri
aaaaaagggtgttttagcggtaatgagttgatcggtcaatgtcaatccgagtaagaaaaaattaacacaatgcaaacccatttgccatgtttcaacacacaaacacaaaacactgataattccacaaatctgatactacaagcagcacaacagtcaattgcaaacataaccaaaaaaagctaaataaacagcagaacctg

SEQ ID NO: 405 - DNA, 200 bp, Amaranthus palmeri
caggttctgctgtttatttagctttttttggttatgtttgcaattgactgttgtgctgcttgtagtatcagatttgtggaattatcagtgttttgtgtttgtgtgttgaaacatggcaaatgggtttgcattgtgttaattttttcttactcggattgacattgaccgatcaactcattaccgctaaaacaccctttttt

SEQ ID NO: 406 - DNA, 200 bp, Amaranthus palmeri
aaagctaaataaacagcagaacctgggatcggaaaagggtggtcggcgtcgtgaacaaactagagagagaaagatgaatatagagagataaaggagtgagaaagaaggaaggagagtaagcagaatgaaatgggtagtgtggagtgtggaataatggttgaaaatgaagtgtggctcttccatagaggatagggatgctg

SEQ ID NO: 407 - DNA, 200 bp, Amaranthus palmeri
cagcatccctatcctctatggaagagccacacttcattttcaaccattattccacactccacactacccatttcattctgcttactctccttccttctttctcactcctttatctctctatattcatctttctctctctagtttgttcacgacgccgaccacccttttccgatcccaggttctgctgtttatttagcttt

SEQ ID NO: 408 - DNA, 200 bp, Amaranthus palmeri
tcttccatagaggatagggatgctgaaattgagtggtgaataaacaatctgaacaagatttggagaatgcaaaagaatctctggactaaattaatggaaaatcaaattgtatgtaatgatttagatatttaattagggttcttgtttgtgtctactcattctgtcactcacatgcatgctcattgtttgtatcaatctaa

SEQ ID NO: 409 - DNA, 200 bp, Amaranthus palmeri
ttagattgatacaaacaatgagcatgcatgtgagtgacagaatgagtagacacaaacaagaaccctaattaaatatctaaatcattacatacaatttgattttccattaatttagtccagagattcttttgcattctccaaatcttgttcagattgtttattcaccactcaatttcagcatccctatcctctatggaaga

SEQ ID NO: 410 - DNA, 200 bp, Amaranthus palmeri
atgctcattgtttgtatcaatctaaagccaagcattgactttttgggaaagccaaatagagaaaacaatatcctaaaggggaaatggactcataaaacgtgattgttactcccacctacagatgttcattcgggtcatcgagttgatttagggtcaggtgtttcgggtaggttcaaaatcgggttttgtgttcacattga

SEQ ID NO: 411 - DNA, 200 bp, Amaranthus palmeri
tcaatgtgaacacaaaacccgattttgaacctacccgaaacacctgaccctaaatcaactcgatgacccgaatgaacatctgtaggtgggagtaacaatcacgttttatgagtccatttcccctttaggatattgttttctctatttggctttcccaaaaagtcaatgcttggctttagattgatacaaacaatgagcat

SEQ ID NO: 412 - DNA, 200 bp, Amaranthus palmeri
aaatcgggttttgtgttcacattgatttttacatgattttaaattcatattgacgtcgggtcaagtcggattagattattaactcgggtaaatatcggatcatcgggtctgttttgaacacctctagtattttccaagttttgttgtatcacacatgcttgttgtggatgacctaaaattctttactgctgaaacgggac

SEQ ID NO: 413 - DNA, 200 bp, Amaranthus palmeri
gtcccgtttcagcagtaaagaattttaggtcatccacaacaagcatgtgtgatacaacaaaacttggaaaatactagaggtgttcaaaacagacccgatgatccgatatttacccgagttaataatctaatccgacttgacccgacgtcaatatgaatttaaaatcatgtaaaaatcaatgtgaacacaaaacccgattt

SEQ ID NO: 414 - DNA, 200 bp, Amaranthus palmeri
aaattctttactgctgaaacgggacattctgtgttgcgttacatttggtttttagtagaatataagtttcggtgggttgttaaggcaaaaaacaagcagatgagaagaaatgtgtggctgagatgaatagagagatttttgcggatagaactaggaaagggcacgtgggttcatatccgtaagtaaaaagttagcatata

SEQ ID NO: 415 - DNA, 200 bp, Amaranthus palmeri
tatatgctaactttttacttacggatatgaacccacgtgccctttcctagttctatccgcaaaaatctctctattcatctcagccacacatttcttctcatctgcttgttttttgccttaacaacccaccgaaacttatattctactaaaaaccaaatgtaacgcaacacagaatgtcccgtttcagcagtaaagaattt

SEQ ID NO: 416 - DNA, 200 bp, Amaranthus palmeri
tccgtaagtaaaaagttagcatataactatagaacaccgaaaaatgaaaaatgtagcgaattgataagtgatcatatgcaatataaagttctggtgttttctgatatattcttttgtgactaaattgaacgggaaaccatcaaaaataatcgtctgtcaaggtattgaaaatcctaacttgggctatcggtgtaggtaac

SEQ ID NO: 417 - DNA, 200 bp, Amaranthus palmeri
gttacctacaccgatagcccaagttaggattttcaataccttgacagacgattatttttgatggtttcccgttcaatttagtcacaaaagaatatatcagaaaacaccagaactttatattgcatatgatcacttatcaattcgctacatttttcatttttcggtgttctatagttatatgctaactttttacttacgga

SEQ ID NO: 418 - DNA, 200 bp, Amaranthus palmeri
aacttgggctatcggtgtaggtaaccataagggtggactttcagtgggaaaagcgatggcctccggatgcaaggctgcggaacttgtaatatcctatctggactctcatttatatgtgaagatggatgagaagaccgtgtaattcttctctgggaacgtcccctgattttgcgtctgtatatccgatgatatgtcgttgg

SEQ ID NO: 419 - DNA, 200 bp, Amaranthus palmeri
ccaacgacatatcatcggatatacagacgcaaaatcaggggacgttcccagagaagaattacacggtcttctcatccatcttcacatataaatgagagtccagataggatattacaagttccgcagccttgcatccggaggccatcgcttttcccactgaaagtccacccttatggttacctacaccgatagcccaagtt

SEQ ID NO: 420 - DNA, 200 bp, Amaranthus palmeri
tgtatatccgatgatatgtcgttggattgatcacgattgtagtcacgtttaggagttgtgcagtgacttttctgcctaaagactggatctgttagaaacaaatagtctatagatagtttctttgctcatcaggttatctttcttacaccagttgtgtatacaaatgttgcatagcctaacctaaattctaaaatgccatt

SEQ ID NO: 421 - DNA, 200 bp, Amaranthus palmeri
aatggcattttagaatttaggttaggctatgcaacatttgtatacacaactggtgtaagaaagataacctgatgagcaaagaaactatctatagactatttgtttctaacagatccagtctttaggcagaaaagtcactgcacaactcctaaacgtgactacaatcgtgatcaatccaacgacatatcatcggatataca

SEQ ID NO: 422 - DNA, 200 bp, Amaranthus palmeri
ctaacctaaattctaaaatgccattcccttttatatagggtcatgttttttgcatttatgaatggtgaaattttagatcttcactgagaataaaggttttggcaatttcataatggtgcttattaggggtatttaaaaccggatattggcaattttcattgataatattgtaatggaaaaatgacgttaaatatcttttt

SEQ ID NO: 423 - DNA, 200 bp, Amaranthus palmeri
aaaaagatatttaacgtcatttttccattacaatattatcaatgaaaattgccaatatccggttttaaatacccctaataagcaccattatgaaattgccaaaacctttattctcagtgaagatctaaaatttcaccattcataaatgcaaaaaacatgaccctatataaaagggaatggcattttagaatttaggttag

SEQ ID NO: 424 - DNA, 200 bp, Amaranthus rudis
acactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgttggatcctttaggaaagggct

SEQ ID NO: 425 - DNA, 200 bp, Amaranthus rudis
agccctttcctaaaggatccaacagtctggcccttaggtttaggaaggcggctgcaaatgaggcaatgtgacattatcaattaaatacatgtatattaaggtaagattcaaggtgatggaaagcaataagtaatggtgattacggacgggtctcgagggggtggaggattatttttcctttcctgaatagttttgagtgt

SEQ ID NO: 426 - DNA, 200 bp, Amaranthus rudis
ctgttggatcctttaggaaagggctcattatgttacctaccgccattgctgctaggtatcttttgactctcaaaccttatatatttctcatcttctccttctgccagtgccatactaatactagtatctttaccatatattttttatttttttaggcttggcagtaaagtcaaactatcgtggacactttctaatattga

SEQ ID NO: 427 - DNA, 200 bp, Amaranthus rudis
tcaatattagaaagtgtccacgatagtttgactttactgccaagcctaaaaaaataaaaaatatatggtaaagatactagtattagtatggcactggcagaaggagaagatgagaaatatataaggtttgagagtcaaaagatacctagcagcaatggcggtaggtaacataatgagccctttcctaaaggatccaacag

SEQ ID NO: 428 - DNA, 200 bp, Amaranthus rudis
tatcgtggacactttctaatattgataagtcgctcaatggagaatacaatctcacttatcaaacacccgatggaccggtttctgttaggaccaaagcggttgtcatgaccgtcccttcgtacattgcaagtagcttgcttcgtccgctctcagtgagtatcattctttccttcatttctattcttttaatgctatccaat

SEQ ID NO: 429 - DNA, 200 bp, Amaranthus rudis
attggatagcattaaaagaatagaaatgaaggaaagaatgatactcactgagagcggacgaagcaagctacttgcaatgtacgaagggacggtcatgacaaccgctttggtcctaacagaaaccggtccatcgggtgtttgataagtgagattgtattctccattgagcgacttatcaatattagaaagtgtccacgata

SEQ ID NO: 430 - DNA, 200 bp, Amaranthus rudis
agagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacga

SEQ ID NO: 431 - DNA, 200 bp, Amaranthus rudis
tcgtaatggtgttctggtaattggcagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgcactctct

SEQ ID NO: 432 - DNA, 200 bp, Amaranthus rudis
gccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggcta

SEQ ID NO: 433 - DNA, 200 bp, Amaranthus rudis
tagccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggtaattggc

SEQ ID NO: 434 - DNA, 200 bp, Amaranthus rudis
tcactaccatggagtccgatggctatatctgggaagagggtcctaatagtttccaaccctccgatcctgtgcttactatggcggtaaactgattcttctctctttctccaatttttgatcattctattcaattttccccttattgaatcaaaatcaaattccaggttgacagtggattaaaagacgatttggtcttggga

SEQ ID NO: 435 - DNA, 200 bp, Amaranthus rudis
tcccaagaccaaatcgtcttttaatccactgtcaacctggaatttgattttgattcaataaggggaaaattgaatagaatgatcaaaaattggagaaagagagaagaatcagtttaccgccatagtaagcacaggatcggagggttggaaactattaggaccctcttcccagatatagccatcggactccatggtagtga

SEQ ID NO: 436 - DNA, 200 bp, Amaranthus rudis
attaaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttg

SEQ ID NO: 437 - DNA, 200 bp, Amaranthus rudis
caacagattcctcataagaaggaggaggaggaggaggacgaagaccaagtgcaccaagaccagccctaatcttaccaggaaagctcatgagatcaaaaaagggaaggtccgtaggtttggaaggaacaggccttaatttaccattccagagcacgaaacgaggggcattaggatctcccaagaccaaatcgtcttttaat

SEQ ID NO: 438 - DNA, 200 bp, Amaranthus rudis
cctccttcttatgaggaatctgttgaagaatttgtgcgccgtaatctcggcgatgaggtcttcgaacgcttgatcgaacccttttgttctggtacctaccctgtttaatttttcaattttcccccttttttctctactactactttattgattcttatccatgagtgtactatgggagttgacaataattgttcaggtgt

SEQ ID NO: 439 - DNA, 200 bp, Amaranthus rudis
acacctgaacaattattgtcaactcccatagtacactcatggataagaatcaataaagtagtagtagagaaaaaagggggaaaattgaaaaattaaacagggtaggtaccagaacaaaagggttcgatcaagcgttcgaagacctcatcgccgagattacggcgcacaaattcttcaacagattcctcataagaaggagg

SEQ ID NO: 440 - DNA, 200 bp, Amaranthus rudis
atggtaattcaatccattacccacctttcaccaaaccttgcattgccatcgccattgtcagtttccaccaagaactacccagtagctgtaatgggcaacatttctgagcgggaagaacccacttctgctaaaagggttgctgttgttggtgctggagttagtggacttgctgctgcatataagctaaaatcccatggttt

SEQ ID NO: 441 - DNA, 200 bp, Amaranthus rudis
aaaccatgggattttagcttatatgcagcagcaagtccactaactccagcaccaacaacagcaacccttttagcagaagtgggttcttcccgctcagaaatgttgcccattacagctactgggtagttcttggtggaaactgacaatggcgatggcaatgcaaggtttggtgaaaggtgggtaatggattgaattaccat

SEQ ID NO: 442 - DNA, 200 bp, Amaranthus rudis
catataagctaaaatcccatggtttgagtgtgacattgtttgaagctgattctagagctggaggcaaacttaaaactgttaaaaaagatggttttatttgggatgagggggcaaatactatgacagaaagtgaggcagaggtctcgagtttgatcgatgatcttgggcttcgtgagaagcaacagttgccaatttcacaa

SEQ ID NO: 443 - DNA, 200 bp, Amaranthus rudis
ttgtgaaattggcaactgttgcttctcacgaagcccaagatcatcgatcaaactcgagacctctgcctcactttctgtcatagtatttgccccctcatcccaaataaaaccatcttttttaacagttttaagtttgcctccagctctagaatcagcttcaaacaatgtcacactcaaaccatgggattttagcttatatg

SEQ ID NO: 444 - DNA, 200 bp, Amaranthus rudis
gaagcaacagttgccaatttcacaaaataaaagatacatagctagagacggtcttcctgtgctactaccttcaaatcccgctgcactactcacgagcaatatcctttcagcaaaatcaaagctgcaaattatgttggaaccatttctctggagaaaacacaatgctactgaactttctgatgagcatgttcaggaaagcg

SEQ ID NO: 445 - DNA, 200 bp, Amaranthus rudis
cgctttcctgaacatgctcatcagaaagttcagtagcattgtgttttctccagagaaatggttccaacataatttgcagctttgattttgctgaaaggatattgctcgtgagtagtgcagcgggatttgaaggtagtagcacaggaagaccgtctctagctatgtatcttttattttgtgaaattggcaactgttgcttc

SEQ ID NO: 446 - DNA, 200 bp, Amaranthus rudis
tctgatgagcatgttcaggaaagcgttggtgaattttttgagcgacattttgggaaagagtttgttgattatgttattgacccttttgttgcgggtacatgtggtggagatcctcaatcgctttccatgcaccatacatttccagaagtatggaatattgaaaaaaggtttggctctgtgtttgctggactaattcaatc

SEQ ID NO: 447 - DNA, 200 bp, Amaranthus rudis
gattgaattagtccagcaaacacagagccaaaccttttttcaatattccatacttctggaaatgtatggtgcatggaaagcgattgaggatctccaccacatgtacccgcaacaaaagggtcaataacataatcaacaaactctttcccaaaatgtcgctcaaaaaattcaccaacgctttcctgaacatgctcatcaga

SEQ ID NO: 448 - DNA, 200 bp, Amaranthus rudis
ctgtgtttgctggactaattcaatcaacattgttatctaagaaggaaaagggtggagaaaatgcttctattaagaagcctcgtgtacgtggttcattttcatttcaaggtggaatgcagacacttgttgacacaatgtgcaaacagcttggtgaagatgaactcaaactccagtgtgaggtgctgtccttgtcatataac

SEQ ID NO: 449 - DNA, 200 bp, Amaranthus rudis
gttatatgacaaggacagcacctcacactggagtttgagttcatcttcaccaagctgtttgcacattgtgtcaacaagtgtctgcattccaccttgaaatgaaaatgaaccacgtacacgaggcttcttaatagaagcattttctccacccttttccttcttagataacaatgttgattgaattagtccagcaaacacag

SEQ ID NO: 450 - DNA, 200 bp, Amaranthus rudis
tgaggtgctgtccttgtcatataaccagaaggggatcccctcattagggaattggtcagtctcttctatgtcaaataataccagtgaagatcaatcttatgatgctgtggttgtcactgctccaattcgcaatgtcaaagaaatgaagattatgaaatttggaaatccattttcacttgactttattccagaggtgacgt

SEQ ID NO: 451 - DNA, 200 bp, Amaranthus rudis
acgtcacctctggaataaagtcaagtgaaaatggatttccaaatttcataatcttcatttctttgacattgcgaattggagcagtgacaaccacagcatcataagattgatcttcactggtattatttgacatagaagagactgaccaattccctaatgaggggatccccttctggttatatgacaaggacagcacctca

SEQ ID NO: 452 - DNA, 200 bp, Amaranthus rudis
cttgactttattccagaggtgacgtacgtacccctttccgttatgattactgcattcaaaaaggataaagtgaagagacctcttgagggcttcggagttcttatcccctctaaagagcaacataatggactgaagactcttggtactttattttcctccatgatgtttcctgatcgtgctccatctgacatgtgtctctt

SEQ ID NO: 453 - DNA, 200 bp, Amaranthus rudis
aagagacacatgtcagatggagcacgatcaggaaacatcatggaggaaaataaagtaccaagagtcttcagtccattatgttgctctttagaggggataagaactccgaagccctcaagaggtctcttcactttatcctttttgaatgcagtaatcataacggaaaggggtacgtacgtcacctctggaataaagtcaag

SEQ ID NO: 454 - DNA, 200 bp, Amaranthus rudis
gtgctccatctgacatgtgtctctttactacatttgtcggaggaagcagaaatagaaaacttgcaaacgcttcaacggatgaattgaagcaaatagtttcttctgaccttcagcagctgttgggcactgaggacgaaccttcatttgtcaatcatctcttttggagcaacgcattcccattgtatggacacaattacgat

SEQ ID NO: 455 - DNA, 200 bp, Amaranthus rudis
atcgtaattgtgtccatacaatgggaatgcgttgctccaaaagagatgattgacaaatgaaggttcgtcctcagtgcccaacagctgctgaaggtcagaagaaactatttgcttcaattcatccgttgaagcgtttgcaagttttctatttctgcttcctccgacaaatgtagtaaagagacacatgtcagatggagcac

SEQ ID NO: 456 - DNA, 200 bp, Amaranthus rudis
cccattgtatggacacaattacgattctgttttgagagccatagacaagatggaaaaggatcttcctggatttttttatgcaggtaaccataagggtggactttcagtgggaaaagcgatggcctccggatgcaaggctgcggaacttgtaatatcctatctggactctcatatatacgtgaagatggatgagaagaccg

SEQ ID NO: 457 - DNA, 200 bp, Amaranthus rudis
cggtcttctcatccatcttcacgtatatatgagagtccagataggatattacaagttccgcagccttgcatccggaggccatcgcttttcccactgaaagtccacccttatggttacctgcataaaaaaatccaggaagatccttttccatcttgtctatggctctcaaaacagaatcgtaattgtgtccatacaatggg

SEQ ID NO: 458 - DNA, 200 bp, Amaranthus rudis
attaagttttgatgtttttagctgcaataatttgttgatgaaaaagccactacttttttctcagctgcaaattatgttggaaccatttctctggagaaaacacaatgctactgaactttctgatgagcatgttcaggaaaggcaagtgccacatactattaagtgttagttgctgagaatatatttgaatctaagatgca

SEQ ID NO: 459 - DNA, 200 bp, Amaranthus rudis
tgcatcttagattcaaatatattctcagcaactaacacttaatagtatgtggcacttgcctttcctgaacatgctcatcagaaagttcagtagcattgtgttttctccagagaaatggttccaacataatttgcagctgagaaaaaagtagtggctttttcatcaacaaattattgcagctaaaaacatcaaaacttaat

SEQ ID NO: 460 - DNA, 200 bp, Amaranthus rudis
agaatatatttgaatctaagatgcacgaagaccactggtgcccttgctctatcaattctgatggaaaggattatcgctgaatttaccttctactaaaacatcgataaaatacttcattattagcatcaaaagattccctccatccttctggttttgctagacttgccttatgaaggtgttcaaggagtagtttgctaccc

SEQ ID NO: 461 - DNA, 200 bp, Amaranthus rudis
gggtagcaaactactccttgaacaccttcataaggcaagtctagcaaaaccagaaggatggagggaatcttttgatgctaataatgaagtattttatcgatgttttagtagaaggtaaattcagcgataatcctttccatcagaattgatagagcaagggcaccagtggtcttcgtgcatcttagattcaaatatattct

SEQ ID NO: 462 - DNA, 200 bp, Amaranthus rudis
gtgttcaaggagtagtttgctacccttcaagatagggtagtggttgccgtctctcataatttcagtcactcgttttcctctcctaattcaagccataatttttatggttcctccacacaacacttgctaaatttgaaaagtagcaaagaggaagtgagcaaaatcagcaggagtaggactgatgagtaagagcttgatta

SEQ ID NO: 463 - DNA, 200 bp, Amaranthus rudis
taatcaagctcttactcatcagtcctactcctgctgattttgctcacttcctctttgctacttttcaaatttagcaagtgttgtgtggaggaaccataaaaattatggcttgaattaggagaggaaaacgagtgactgaaattatgagagacggcaaccactaccctatcttgaagggtagcaaactactccttgaacac

SEQ ID NO: 464 - DNA, 200 bp, Amaranthus rudis
ggactgatgagtaagagcttgattaagtgtagaggattttcttttgtgttgaatatgaatgcatcatgcatgactgtagaattgacataatgatttgtctgcagcgttggtgaattttttgagcgacattttgggaaagaggtattgttgccaattgccatgctctattcattccggtgaattaacaaatgttgtgcttc

SEQ ID NO: 465 - DNA, 200 bp, Amaranthus rudis
gaagcacaacatttgttaattcaccggaatgaatagagcatggcaattggcaacaatacctctttcccaaaatgtcgctcaaaaaattcaccaacgctgcagacaaatcattatgtcaattctacagtcatgcatgatgcattcatattcaacacaaaagaaaatcctctacacttaatcaagctcttactcatcagtcc

SEQ ID NO: 466 - DNA, 200 bp, Amaranthus rudis
ggtgaattaacaaatgttgtgcttctgcttactattgcttataattattgtttgttgcagtttgttgattatgttattgacccttttgttgcgggtacatgtggtggagatcctcaatcgctttccgtgagttaaatactgtgcttgcttttttttttttcaacattttctggaggctgtaaataaattatactcctttc

SEQ ID NO: 467 - DNA, 200 bp, Amaranthus rudis
gaaaggagtataatttatttacagcctccagaaaatgttgaaaaaaaaaaaagcaagcacagtatttaactcacggaaagcgattgaggatctccaccacatgtacccgcaacaaaagggtcaataacataatcaacaaactgcaacaaacaataattataagcaatagtaagcagaagcacaacatttgttaattcacc

SEQ ID NO: 468 - DNA, 200 bp, Amaranthus rudis
gctgtaaataaattatactcctttctattctaatcaaatatcctatttccccttttggcatattcaaatttagttaaatattgtgtaaattatttacacaattgccattaaattttcacttttcccttactcactcttctcatgtgtcccttcccccttttcttaaaattggtgcattatcaaataggacatttgatttg

SEQ ID NO: 469 - DNA, 200 bp, Amaranthus rudis
caaatcaaatgtcctatttgataatgcaccaattttaagaaaagggggaagggacacatgagaagagtgagtaagggaaaagtgaaaatttaatggcaattgtgtaaataatttacacaatatttaactaaatttgaatatgccaaaaggggaaataggatatttgattagaatagaaaggagtataatttatttacagc

SEQ ID NO: 470 - DNA, 200 bp, Amaranthus rudis
attatcaaataggacatttgatttgaataggcgggagtttccaattgtgcttccaaaggtagcttgtcactttttctttttctttaaattttgtaccatgccatgcattttgaacctcaactcatttcgccataaaggaatattatgtttgagaagaacgaggatactattatcttatagataacatataggtttcatta

SEQ ID NO: 471 - DNA, 200 bp, Amaranthus rudis
taatgaaacctatatgttatctataagataatagtatcctcgttcttctcaaacataatattcctttatggcgaaatgagttgaggttcaaaatgcatggcatggtacaaaatttaaagaaaaagaaaaagtgacaagctacctttggaagcacaattggaaactcccgcctattcaaatcaaatgtcctatttgataat

SEQ ID NO: 472 - DNA, 200 bp, Amaranthus rudis
tatagataacatataggtttcattatcaatgattgtttgattttcaactcttcttttcctttcatgctcatattgatgttatttctatttgttatgaattatgtccattgtgttaatgtctttctttattgtagatgcaccatacatttccagaagtatggaatattgaaaaaaggtatgaaccttaaagctttaatttt

SEQ ID NO: 473 - DNA, 200 bp, Amaranthus rudis
aaaattaaagctttaaggttcataccttttttcaatattccatacttctggaaatgtatggtgcatctacaataaagaaagacattaacacaatggacataattcataacaaatagaaataacatcaatatgagcatgaaaggaaaagaagagttgaaaatcaaacaatcattgataatgaaacctatatgttatctata

SEQ ID NO: 474 - DNA, 200 bp, Amaranthus rudis
gtatgaaccttaaagctttaattttcttcgaacttaatgtttcttaattgattcttttggatcaatttccataagaatggaaatttaaaaaagggtatgaaccttaaagatttcttcgaacttatatgttttgtaattcatgcttttagatgctgcaccattttatctatgtgtcttaagtttgttgtaatcatttgtag

SEQ ID NO: 475 - DNA, 200 bp, Amaranthus rudis
ctacaaatgattacaacaaacttaagacacatagataaaatggtgcagcatctaaaagcatgaattacaaaacatataagttcgaagaaatctttaaggttcatacccttttttaaatttccattcttatggaaattgatccaaaagaatcaattaagaaacattaagttcgaagaaaattaaagctttaaggttcatac

SEQ ID NO: 476 - DNA, 200 bp, Amaranthus rudis
ttaagtttgttgtaatcatttgtagaccaaaagaatgaatggtctggtttgaaatggttcatcgtgcaaaaatgcgattttgcttgtgattgaggtaacattcaaggtggtgtgtttgtcgtactgtcaaatgtcttcctataccatgtgatatatatataagcctaaaatgatatattgtacacctttaggatgtggat

SEQ ID NO: 477 - DNA, 200 bp, Amaranthus rudis
atccacatcctaaaggtgtacaatatatcattttaggcttatatatatatcacatggtataggaagacatttgacagtacgacaaacacaccaccttgaatgttacctcaatcacaagcaaaatcgcatttttgcacgatgaaccatttcaaaccagaccattcattcttttggtctacaaatgattacaacaaacttaa

SEQ ID NO: 478 - DNA, 200 bp, Amaranthus rudis
tattgtacacctttaggatgtggatagcaggggttcagtacatatgaaaaatccttgcaatttgatctgtacgatcaatgtgattttgccttttgccttttgccttttgttatatgatgatgattccatgtgaaattttgggatttagaaaattcacttgtttaagaacatttgaatcaaactttcaccaatttcaacca

SEQ ID NO: 479 - DNA, 200 bp, Amaranthus rudis
tggttgaaattggtgaaagtttgattcaaatgttcttaaacaagtgaattttctaaatcccaaaatttcacatggaatcatcatcatataacaaaaggcaaaaggcaaaaggcaaaatcacattgatcgtacagatcaaattgcaaggatttttcatatgtactgaacccctgctatccacatcctaaaggtgtacaata

SEQ ID NO: 480 - DNA, 200 bp, Amaranthus rudis
atcaaactttcaccaatttcaaccacatttaattgcggcaaagccgaactttaaaagtcactcccaatctttgagatatccaaactccaaaacttctattagctttcatgttttcaccaagtaaagttggtgcgactccttaccattttctttattatgcatttcgttgatgtataatagtatagattggtgctctcttt

SEQ ID NO: 481 - DNA, 200 bp, Amaranthus rudis
aaagagagcaccaatctatactattatacatcaacgaaatgcataataaagaaaatggtaaggagtcgcaccaactttacttggtgaaaacatgaaagctaatagaagttttggagtttggatatctcaaagattgggagtgacttttaaagttcggctttgccgcaattaaatgtggttgaaattggtgaaagtttgat

SEQ ID NO: 482 - DNA, 200 bp, Amaranthus rudis
aatagtatagattggtgctctctttgctctccttccaacatgcataacttctagttcttgtcgttttcttttcctccctatttttatttgacttgtagctatttttgttcactcttctcgcccaatccatagctaaagaaacttgatttcattgattttgtaactgatatgcaattcatttttgtttgcttttagttgtt

SEQ ID NO: 483 - DNA, 200 bp, Amaranthus rudis
aacaactaaaagcaaacaaaaatgaattgcatatcagttacaaaatcaatgaaatcaagtttctttagctatggattgggcgagaagagtgaacaaaaatagctacaagtcaaataaaaatagggaggaaaagaaaacgacaagaactagaagttatgcatgttggaaggagagcaaagagagcaccaatctatactatt

SEQ ID NO: 484 - DNA, 200 bp, Amaranthus rudis
tcatttttgtttgcttttagttgttgattcaaaaacaataatgctaaagccctaatcctaacatgtcgggttagctgttgaaacaatacttgaaattgctataaaaagggattttttttcgggtacttcagttgttgagattgatatggtcaagtataatttgttttaacacaatttgtaatgatttaatggcttagttt

SEQ ID NO: 485 - DNA, 200 bp, Amaranthus rudis
aaactaagccattaaatcattacaaattgtgttaaaacaaattatacttgaccatatcaatctcaacaactgaagtacccgaaaaaaaatccctttttatagcaatttcaagtattgtttcaacagctaacccgacatgttaggattagggctttagcattattgtttttgaatcaacaactaaaagcaaacaaaaatga

SEQ ID NO: 486 - DNA, 200 bp, Amaranthus rudis
ttgtaatgatttaatggcttagtttcatagctgtttgtattaataaaggaaggaggactatctgaaattgcaataggaaagagattttagttcggtatttggttgtttaaattgatatggccaagtaatgttcattttacacaattggtaatgttttattggctcaatagtgtttgtaagtatgcgactcaaatttaatc

SEQ ID NO: 487 - DNA, 200 bp, Amaranthus rudis
gattaaatttgagtcgcatacttacaaacactattgagccaataaaacattaccaattgtgtaaaatgaacattacttggccatatcaatttaaacaaccaaataccgaactaaaatctctttcctattgcaatttcagatagtcctccttcctttattaatacaaacagctatgaaactaagccattaaatcattacaa

SEQ ID NO: 488 - DNA, 200 bp, Amaranthus rudis
gtaagtatgcgactcaaatttaatcaagtataacttattgaaacataaataaatatccattaggtttggctctgtgtttgctggactaattcaatcaacattgttatctaagaaggaaaagggtggagaaaatgcttctattaagaagcctcgtgtacgtggttcattttcatttcaaggtggaatgcaggtataaactt

SEQ ID NO: 489 - DNA, 200 bp, Amaranthus rudis
aagtttatacctgcattccaccttgaaatgaaaatgaaccacgtacacgaggcttcttaatagaagcattttctccacccttttccttcttagataacaatgttgattgaattagtccagcaaacacagagccaaacctaatggatatttatttatgtttcaataagttatacttgattaaatttgagtcgcatacttac

SEQ ID NO: 490 - DNA, 200 bp, Amaranthus rudis
caaggtggaatgcaggtataaacttgtagccataatttcactttttataccttatacttccaaaatatattgatgcgtttttcttgctacaaagtacaaacacaaaagctttgggaataattctcaattttgtcaaatctactaaaaatattctattaggaatcaaggtttctattttagaatatatggatgaagacatg

SEQ ID NO: 491 - DNA, 200 bp, Amaranthus rudis
catgtcttcatccatatattctaaaatagaaaccttgattcctaatagaatatttttagtagatttgacaaaattgagaattattcccaaagcttttgtgtttgtactttgtagcaagaaaaacgcatcaatatattttggaagtataaggtataaaaagtgaaattatggctacaagtttatacctgcattccaccttg

SEQ ID NO: 492 - DNA, 200 bp, Amaranthus rudis
tttagaatatatggatgaagacatgtagaagtgtgaataaaaaaacctagatgtgaaaggtttttagtctattaaacaagaatattagaattcagagtcgtttcatcaataaaatattgttgaagaggagcaattacattctgcttcaagcaaaggcaatcttaagaggaccctaaaacttgaggaggtatgagaactta

SEQ ID NO: 493 - DNA, 200 bp, Amaranthus rudis
taagttctcatacctcctcaagttttagggtcctcttaagattgcctttgcttgaagcagaatgtaattgctcctcttcaacaatattttattgatgaaacgactctgaattctaatattcttgtttaatagactaaaaacctttcacatctaggtttttttattcacacttctacatgtcttcatccatatattctaaa

SEQ ID NO: 494 - DNA, 200 bp, Amaranthus rudis
aaacttgaggaggtatgagaacttagaggccaaagaaattaaatttgatgaagagatttggtgagataccttgcttacaaaaatgattaattttccccttagacacctcaaattatgacatttataagttctccatgcgtattcgacaagatgttacatcctatattctaaattaagtatgaaatttgtatatgtgtaag

SEQ ID NO: 495 - DNA, 200 bp, Amaranthus rudis
cttacacatatacaaatttcatacttaatttagaatataggatgtaacatcttgtcgaatacgcatggagaacttataaatgtcataatttgaggtgtctaaggggaaaattaatcatttttgtaagcaaggtatctcaccaaatctcttcatcaaatttaatttctttggcctctaagttctcatacctcctcaagttt

SEQ ID NO: 496 - DNA, 200 bp, Amaranthus rudis
agtatgaaatttgtatatgtgtaagaaagaaaagttagtcccttgaattccatgtctacgacctcaaagtgttcataccattgaaattagcgagcttacgattgttaagaaaggatcaacttgtcatcattgatcattgatgaagtgtgtaatagacatactaggtgaaattcaaaagggatctactcagtctttgagtt

SEQ ID NO: 497 - DNA, 200 bp, Amaranthus rudis
aactcaaagactgagtagatcccttttgaatttcacctagtatgtctattacacacttcatcaatgatcaatgatgacaagttgatcctttcttaacaatcgtaagctcgctaatttcaatggtatgaacactttgaggtcgtagacatggaattcaagggactaacttttctttcttacacatatacaaatttcatact

SEQ ID NO: 498 - DNA, 200 bp, Amaranthus rudis
aagggatctactcagtctttgagtttaccgtttgcttctagtattttgctatttataggcactatcaaagggttcaatattgttttttctgaacattgttgccgaattgtgaagggagaatgatggtagatttctcttatttttatgagaaaattctctttataaagagttcgatagctcaaaaatgaaagcttattgcc

SEQ ID NO: 499 - DNA, 200 bp, Amaranthus rudis
ggcaataagctttcatttttgagctatcgaactctttataaagagaattttctcataaaaataagagaaatctaccatcattctcccttcacaattcggcaacaatgttcagaaaaaacaatattgaaccctttgatagtgcctataaatagcaaaatactagaagcaaacggtaaactcaaagactgagtagatccctt

SEQ ID NO: 500 - DNA, 200 bp, Amaranthus rudis
agctcaaaaatgaaagcttattgccaaaagtggatggggtagatgaaggagaaatgcaatcaattttggtaggcttgactttgagtaaagaatttgtggaataaggtagaaaaataggatttggctgcatgatattgaaaccttttgctacttttctttttgttttggttgcaatgcacagaaaggcaggacggtaaagt

SEQ ID NO: 501 - DNA, 200 bp, Amaranthus rudis
actttaccgtcctgcctttctgtgcattgcaaccaaaacaaaaagaaaagtagcaaaaggtttcaatatcatgcagccaaatcctatttttctaccttattccacaaattctttactcaaagtcaagcctaccaaaattgattgcatttctccttcatctaccccatccacttttggcaataagctttcatttttgagct

SEQ ID NO: 502 - DNA, 200 bp, Amaranthus rudis
gcacagaaaggcaggacggtaaagtgtgataaaatggatgggaaaaattgctagaatagaatagaagaaaaataatggcaggatgtatcctttgttaccctagtttcgacaactgtgttacgtcggtattatcggtggcttggactgagtcatcatagaaattcttctctgatatagtttagatgaaatttttaaaattt

SEQ ID NO: 503 - DNA, 200 bp, Amaranthus rudis
aaattttaaaaatttcatctaaactatatcagagaagaatttctatgatgactcagtccaagccaccgataataccgacgtaacacagttgtcgaaactagggtaacaaaggatacatcctgccattatttttcttctattctattctagcaatttttcccatccattttatcacactttaccgtcctgcctttctgtgc

SEQ ID NO: 504 - DNA, 200 bp, Amaranthus rudis
agtttagatgaaatttttaaaatttaagcaggcctgaattttgataaagatagcatgatctaaagaaggcagctctaataaatcaacataaaatttgatattaagtagtctctgtctaggcctgctttccgagctagtatattaactgagtacatgttattagagcaatagcataggagtcatgtttttgcatactgatt

SEQ ID NO: 505 - DNA, 200 bp, Amaranthus rudis
aatcagtatgcaaaaacatgactcctatgctattgctctaataacatgtactcagttaatatactagctcggaaagcaggcctagacagagactacttaatatcaaattttatgttgatttattagagctgccttctttagatcatgctatctttatcaaaattcaggcctgcttaaattttaaaaatttcatctaaact

SEQ ID NO: 506 - DNA, 200 bp, Amaranthus rudis
ggagtcatgtttttgcatactgattagcatgtcaattttattccatttgctgagtactgtatgttctgcagacacttgttgacacaatgtgcaaacagcttggtgaagatgaactcaaactccagtgtgaggtgctgtccttgtcatataaccagaaggggatcccctcattagggaattggtcagtctcttctatgtca

SEQ ID NO: 507 - DNA, 200 bp, Amaranthus rudis
tgacatagaagagactgaccaattccctaatgaggggatccccttctggttatatgacaaggacagcacctcacactggagtttgagttcatcttcaccaagctgtttgcacattgtgtcaacaagtgtctgcagaacatacagtactcagcaaatggaataaaattgacatgctaatcagtatgcaaaaacatgactcc

SEQ ID NO: 508 - DNA, 200 bp, Amaranthus rudis
gaattggtcagtctcttctatgtcaaataataccagtgaagatcaatcttatgatgctgtggttgtcactgtgagtttttgtctacttttgtctctatgagcatgcaattcctttcacagccgttgagttagcaattatattccagtttgaaacttaaagttttttgggggaatttttctagcattcaagtcaatcaagg

SEQ ID NO: 509 - DNA, 200 bp, Amaranthus rudis
ccttgattgacttgaatgctagaaaaattcccccaaaaaactttaagtttcaaactggaatataattgctaactcaacggctgtgaaaggaattgcatgctcatagagacaaaagtagacaaaaactcacagtgacaaccacagcatcataagattgatcttcactggtattatttgacatagaagagactgaccaattc

SEQ ID NO: 510 - DNA, 200 bp, Amaranthus rudis
tttctagcattcaagtcaatcaaggcttatttggaactcaaagctttatctatgttatatgaaactacaataaaatgatttctaaaaaattaattgcgaatagcggagattcaattagggtgtataattgatccacatcaaatagcatgcattctacatgttagtcacttgtggcttctctagtcctctgtctccagaaa

SEQ ID NO: 511 - DNA, 200 bp, Amaranthus rudis
tttctggagacagaggactagagaagccacaagtgactaacatgtagaatgcatgctatttgatgtggatcaattatacaccctaattgaatctccgctattcgcaattaattttttagaaatcattttattgtagtttcatataacatagataaagctttgagttccaaataagccttgattgacttgaatgctagaaa

SEQ ID NO: 512 - DNA, 200 bp, Amaranthus rudis
ttctctagtcctctgtctccagaaaaagcctgcatacaaaggctcatgaagactagtatgctatatactttccgaaatgtcagcattaagtaacttgtgttgaggaaatatgtaaatcgtaccctgttaccctctttttaaagagtgattttttttttaattgaatgtggttatagctatctggtttgatgaagatttac

SEQ ID NO: 513 - DNA, 200 bp, Amaranthus rudis
gtaaatcttcatcaaaccagatagctataaccacattcaattaaaaaaaaaatcactctttaaaaagagggtaacagggtacgatttacatatttcctcaacacaagttacttaatgctgacatttcggaaagtatatagcatactagtcttcatgagcctttgtatgcaggctttttctggagacagaggactagagaa

SEQ ID NO: 514 - DNA, 200 bp, Amaranthus rudis
gctatctggtttgatgaagatttaccattcttaatgaagcaaaaaattttaagttcacaagtttcaattatattaggcatttaggctgctatacagtgaattggctcgataaattttgcgcatgtcttatttatgtgaattgtagataacgtttgctacaaagggtcaatcaagaacaaccttttcatttttgtaaggat

SEQ ID NO: 515 - DNA, 200 bp, Amaranthus rudis
atccttacaaaaatgaaaaggttgttcttgattgaccctttgtagcaaacgttatctacaattcacataaataagacatgcgcaaaatttatcgagccaattcactgtatagcagcctaaatgcctaatataattgaaacttgtgaacttaaaattttttgcttcattaagaatggtaaatcttcatcaaaccagatagc

SEQ ID NO: 516 - DNA, 200 bp, Amaranthus rudis
acaaccttttcatttttgtaaggataactcctaaattctgcctaggttggaggatatgtggaagtcacttaatggcaataggactgaaatattgttgaatatggttatctagtaccaattcacacttgtatacatgagtacatgtctaatgctctttgttgtgatttacttaaacaagaattatgttcattagcaggctt

SEQ ID NO: 517 - DNA, 200 bp, Amaranthus rudis
aagcctgctaatgaacataattcttgtttaagtaaatcacaacaaagagcattagacatgtactcatgtatacaagtgtgaattggtactagataaccatattcaacaatatttcagtcctattgccattaagtgacttccacatatcctccaacctaggcagaatttaggagttatccttacaaaaatgaaaaggttgt

SEQ ID NO: 518 - DNA, 200 bp, Amaranthus rudis
aagaattatgttcattagcaggctttcatgctctctgtacagcaccttatctttcctttaccacgatactatttgtcttgtttaattatacatatatcataaatgtttcgacattcggtctaaaatattttggatgggtgtatactgtttaatgcaacaatatgtaaaatagatacataaagaaaagtaaaaggaataat

SEQ ID NO: 519 - DNA, 200 bp, Amaranthus rudis
attattccttttacttttctttatgtatctattttacatattgttgcattaaacagtatacacccatccaaaatattttagaccgaatgtcgaaacatttatgatatatgtataattaaacaagacaaatagtatcgtggtaaaggaaagataaggtgctgtacagagagcatgaaagcctgctaatgaacataattctt

SEQ ID NO: 520 - DNA, 200 bp, Amaranthus rudis
cataaagaaaagtaaaaggaataatgaattacaaaaaatacgatgaaaattgaaaatggatgttgtatttcaaaaggaggttaaaggagtgatttgcttccaaagtagaaatcattccgagttcgtagattgttttaagaataccgagtgtagtatggattatggtggacaaaattttctataatattttttcataaaca

SEQ ID NO: 521 - DNA, 200 bp, Amaranthus rudis
tgtttatgaaaaaatattatagaaaattttgtccaccataatccatactacactcggtattcttaaaacaatctacgaactcggaatgatttctactttggaagcaaatcactcctttaacctccttttgaaatacaacatccattttcaattttcatcgtattttttgtaattcattattccttttacttttctttatg

SEQ ID NO: 522 - DNA, 200 bp, Amaranthus rudis
gagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacg

SEQ ID NO: 523 - DNA, 200 bp, Amaranthus rudis
cgtaatggtgttctggtaattggcagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgcactctctc

SEQ ID NO: 524 - DNA, 200 bp, Amaranthus rudis
tgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggct

SEQ ID NO: 525 - DNA, 200 bp, Amaranthus rudis
agccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggtaattggca

SEQ ID NO: 526 - DNA, 200 bp, Amaranthus rudis
atcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttt

SEQ ID NO: 527 - DNA, 200 bp, Amaranthus rudis
aaaaagggaaggtccgtaggtttggaaggaacaggccttaatttaccattccagagcacgaaacgaggggcattaggatctcccaagaccaaatcgtctttcaatccactgtcaaccgccatagtaagcacaggatcggagggttggaaactattaggaccctcttcccagatatagccatcggactccatggtagtgat

SEQ ID NO: 528 - DNA, 200 bp, Amaranthus rudis
ccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggt

SEQ ID NO: 529 - DNA, 200 bp, Amaranthus rudis
accagcatagacaccagaacaaaagggttcgatcaagcgttcgaagacctcatcgccgagattacggcgcacaaattcttcaacagattcctcataagaaggaggaggaggaggaggacgaagaccaagtgcaccaagaccagccctaatcttaccaggaaagctcatgagatcaaaaaagggaaggtccgtaggtttgg

SEQ ID NO: 530 - DNA, 200 bp, Amaranthus rudis
cttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatccttta

SEQ ID NO: 531 - DNA, 200 bp, Amaranthus rudis
taaaggatccaacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgcaggatcaccagcatagacaccagaacaaaag

SEQ ID NO: 532 - DNA, 200 bp, Amaranthus rudis
aagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtccc

SEQ ID NO: 533 - DNA, 200 bp, Amaranthus rudis
gggacagtcatgacaaccgctttggtcctaacagaaaccggtccatcgggtgtttgataagtgagaatgtattcaccattgagcgacttatcaatattagaaagtgtccacgatagtttgactttactgccaagcctagcagcaatggcggtaggtaacataatgagccctttcctaaaggatccaacagtctggccctt

SEQ ID NO: 534 - DNA, 200 bp, Amaranthus rudis
gcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaagg

SEQ ID NO: 535 - DNA, 200 bp, Amaranthus rudis
ccttggctcgtaatggtgttctggtaattggcagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgc

SEQ ID NO: 536 - DNA, 200 bp, Amaranthus rudis
accagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgg

SEQ ID NO: 537 - DNA, 200 bp, Amaranthus rudis
ccagatatagccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggt

SEQ ID NO: 538 - DNA, 200 bp, Amaranthus rudis
catggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctca

SEQ ID NO: 539 - DNA, 200 bp, Amaranthus rudis
tgagatcaaaaaagggaaggtccgtaggtttggaaggaacaggccttaatttaccattccagagcacgaaacgaggggcattaggatctcccaagaccaaatcgtctttcaatccactgtcaaccgccatagtaagcacaggatcggagggttggaaactattaggaccctcttcccagatatagccatcggactccatg

SEQ ID NO: 540 - DNA, 200 bp, Amaranthus rudis
acggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggtgatcctgc

SEQ ID NO: 541 - DNA, 200 bp, Amaranthus rudis
gcaggatcaccagcatagacaccagaacaaaagggttcgatcaagcgttcgaagacctcatcgccgagattacggcgcacaaattcttcaacagattcctcataagaaggaggaggaggaggaggacgaagaccaagtgcaccaagaccagccctaatcttaccaggaaagctcatgagatcaaaaaagggaaggtccgt

SEQ ID NO: 542 - DNA, 200 bp, Amaranthus rudis
ctggtgtctatgctggtgatcctgcaaagttgagtatgaaagctgcatttggaaaggtctggaccttagagcaaaagggtggtagtatcatagccggtacactcaaaactattcaggaaaggaaaaataatcctctaccccctcgagacccccgccttcctaaacctaagggccagactgttggatcctttaggaaaggg

SEQ ID NO: 543 - DNA, 200 bp, Amaranthus rudis
ccctttcctaaaggatccaacagtctggcccttaggtttaggaaggcgggggtctcgagggggtagaggattatttttcctttcctgaatagttttgagtgtaccggctatgatactaccacccttttgctctaaggtccagacctttccaaatgcagctttcatactcaactttgcaggatcaccagcatagacaccag

SEQ ID NO: 544 - DNA, 200 bp, Amaranthus rudis
gactgttggatcctttaggaaagggctcattatgttacctaccgccattgctgctaggcttggcagtaaagtcaaactatcgtggacactttctaatattgataagtcgctcaatggagaatacaatctcacttatcaaacacccgatggaccggtttctgttaggaccaaagcggttgtcatgaccgtcccttcgtaca

SEQ ID NO: 545 - DNA, 200 bp, Amaranthus rudis
tgtacgaagggacggtcatgacaaccgctttggtcctaacagaaaccggtccatcgggtgtttgataagtgagattgtattctccattgagcgacttatcaatattagaaagtgtccacgatagtttgactttactgccaagcctagcagcaatggcggtaggtaacataatgagccctttcctaaaggatccaacagtc

SEQ ID NO: 546 - DNA, 200 bp, Amaranthus rudis
gttgtcatgaccgtcccttcgtacattgcaagtagcttgcttcgtccgctctcagatgttgctgcagattctctttctaaattttactatccaccagtcgcagcagtgtccctttcttatcccaaagaagcaattagaccagaatgcttgattgatggagaactaaaaggattcgggcaattgcatccccgcagccaggg

SEQ ID NO: 547 - DNA, 200 bp, Amaranthus rudis
ccctggctgcggggatgcaattgcccgaatccttttagttctccatcaatcaagcattctggtctaattgcttctttgggataagaaagggacactgctgcgactggtggatagtaaaatttagaaagagaatctgcagcaacatctgagagcggacgaagcaagctacttgcaatgtacgaagggacggtcatgacaac

SEQ ID NO: 548 - DNA, 200 bp, Amaranthus rudis
ggcaattgcatccccgcagccagggtgtggaaaccttgggtacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaat

SEQ ID NO: 549 - DNA, 200 bp, Amaranthus rudis
atttatcagaatttttctgagatccttatcaactgtctccgcaagttcatcttcactcttttgtaatatgccaagatttgtagcacctccaatgtagctcaagatcaaggtcctaccgggtggtgctcgaccagggaaaagagatgaactataaattgtacccaaggtttccacaccctggctgcggggatgcaattgcc

SEQ ID NO: 550 - DNA, 200 bp, Amaranthus rudis
ggatctcagaaaaattctgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggt

SEQ ID NO: 551 - DNA, 200 bp, Amaranthus rudis
acctccccaaggcaacacctgatacataattaccaccaagaaacaacccctttagcccagcatttgccaaaccagcttttgcagcatctagcacatcaaagtgaccaactaaaaattgggggattgcctttggccatactctcactcccagaacacggctgcctttcgcatttggatttatcagaatttttctgagatcc

SEQ ID NO: 552 - DNA, 200 bp, Amaranthus rudis
gtatcaggtgttgccttggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcat

SEQ ID NO: 553 - DNA, 200 bp, Amaranthus rudis
atgcttttacatctttccaaacttgtttgagtgtgggctattttacatctttccaaattacaacagctacaaaaagttacttaaccaagatgctggagccctattgactacttatctttgtactgtgagaggaaatccactacctcagaagcagagtcataagcaccctctatacacctccccaaggcaacacctgatac

SEQ ID NO: 554 - DNA, 200 bp, Amaranthus rudis
ggccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcag

SEQ ID NO: 555 - DNA, 200 bp, Amaranthus rudis
ctgcctttcgcatttggatttatcagaatttttctgagatccttatcaactgtctccgcaagttcatcttcactcttttgtaatatgccaagatttgtagcacctccaatgtagctcaagatcaaggtcctaccgggtggtgctcgaccagggaaaagagatgaactataaattgttcccaaggtttccacaccctggcc

SEQ ID NO: 556 - DNA, 200 bp, Amaranthus rudis
tgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggtgtatagagggtgcttat

SEQ ID NO: 557 - DNA, 200 bp, Amaranthus rudis
ataagcaccctctatacacctccccaaggcaacacctgatacataattaccaccaagaaacaacccctttagcccagcatttgccaaaccagcttttgcagcatctagcacatcaaagtgaccaactaaaaattgggggattgcctttggccatactctcactcccagaacacggctgcctttcgcatttggatttatca

SEQ ID NO: 558 - DNA, 200 bp, Amaranthus rudis
ggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcatgagatacagtcggtgtt

SEQ ID NO: 559 - DNA, 200 bp, Amaranthus rudis
aacaccgactgtatctcatgcttttacatctttccaaacttgtttgagtgtgggctattttacatctttccaaattacaacagctacaaaaagttacttaaccaagatgctggagccctattgactacttatctttgtactgtgagaggaaatccactacctcagaagcagagtcataagcaccctctatacacctcccc

SEQ ID NO: 560 - DNA, 200 bp, Amaranthus rudis
gtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccg

SEQ ID NO: 561 - DNA, 200 bp, Amaranthus rudis
cggcgcacaaattcttcaacagattcctcataagaaggaggaggaggaggaggacgaagaccaagtgcaccaagaccagccctaatcttaccaggaaagctcatgagatcaaaaaagggaaggtccgtaggtttggaaggaacaggccttaatttaccattccagagcacgaaacgaggggcattaggatctcccaagac

SEQ ID NO: 562 - DNA, 200 bp, Amaranthus rudis
ggtggtagtatcatagccggtacactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgt

SEQ ID NO: 563 - DNA, 200 bp, Amaranthus rudis
acagtctggcccttaggtttaggaaggcggctgcaaatgaggcaatgtgacattatcaattaaatacatgtatattaaggtaagattcaaggtgatggaaagcaataagtaatggtgattacggacgggtctcgagggggtggaggattatttttcctttcctgaatagttttgagtgtaccggctatgatactaccacc

SEQ ID NO: 564 - DNA, 200 bp, Amaranthus rudis
ttgatttgaagataggataaccagagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactg

SEQ ID NO: 565 - DNA, 200 bp, Amaranthus rudis
cagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgcactctctctggttatcctatcttcaaatcaa

SEQ ID NO: 566 - DNA, 200 bp, Amaranthus rudis
tgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatat

SEQ ID NO: 567 - DNA, 200 bp, Amaranthus rudis
atattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggtaattggcagttgagcttgagcttgtggaaca

SEQ ID NO: 568 - DNA, 200 bp, Amaranthus rudis
ttttaaccaatcctcaaaatttacaccatggagatgtctgcggataagaattagtaactgtagcagctgtaattgttgcatgcagttttatggtttgccttgcaattcaaacttgggatattgtttgccttgcaatttgtagtttagtgtttgcccttcactttgtattttagttatttttttcattgcaatttgctctt

SEQ ID NO: 569 - DNA, 200 bp, Amaranthus rudis
aagagcaaattgcaatgaaaaaaataactaaaatacaaagtgaagggcaaacactaaactacaaattgcaaggcaaacaatatcccaagtttgaattgcaaggcaaaccataaaactgcatgcaacaattacagctgctacagttactaattcttatccgcagacatctccatggtgtaaattttgaggattggttaaaa

SEQ ID NO: 570 - DNA, 200 bp, Amaranthus rudis
atttttttcattgcaatttgctctttgaagtataaaatggtgacctttcttgctcaggatgttgctgcagattctctttctaaattttactatccaccagtcgcagcagtgtccctttcttatcccaaagaagcaattagaccagaatgcttgatcgatggagaactaaaaggattcgggcaattgcatccccgcagcca

SEQ ID NO: 571 - DNA, 200 bp, Amaranthus rudis
tggctgcggggatgcaattgcccgaatccttttagttctccatcgatcaagcattctggtctaattgcttctttgggataagaaagggacactgctgcgactggtggatagtaaaatttagaaagagaatctgcagcaacatcctgagcaagaaaggtcaccattttatacttcaaagagcaaattgcaatgaaaaaaat

SEQ ID NO: 572 - DNA, 200 bp, Amaranthus rudis
tcgggcaattgcatccccgcagccagggtgtggaaaccttgggtatatgctcccattcaactatatctcaataattatgagtatttttctttctctggattattcaatttggtgacgttaaattttgactgtactcgacaggaacaatttatagttcatctcttttccctggtcgagcaccacccggtaggaccttgatc

SEQ ID NO: 573 - DNA, 200 bp, Amaranthus rudis
gatcaaggtcctaccgggtggtgctcgaccagggaaaagagatgaactataaattgttcctgtcgagtacagtcaaaatttaacgtcaccaaattgaataatccagagaaagaaaaatactcataattattgagatatagttgaatgggagcatatacccaaggtttccacaccctggctgcggggatgcaattgcccga

SEQ ID NO: 574 - DNA, 200 bp, Amaranthus rudis
agcaccacccggtaggaccttgatcttgagctacattggaggtgctacaaatcttggcatattacaaaaggcaagtcatttatacaattatatgtgtccttgtatcctcaaataagtcgtatcaatcctgacgacatgcttctatcaatgcagagtgaagatgaacttgcggagacagttgataaggatctcagaaaaat

SEQ ID NO: 575 - DNA, 200 bp, Amaranthus rudis
atttttctgagatccttatcaactgtctccgcaagttcatcttcactctgcattgatagaagcatgtcgtcaggattgatacgacttatttgaggatacaaggacacatataattgtataaatgacttgccttttgtaatatgccaagatttgtagcacctccaatgtagctcaagatcaaggtcctaccgggtggtgct

SEQ ID NO: 576 - DNA, 200 bp, Amaranthus rudis
cagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgcc

SEQ ID NO: 577 - DNA, 200 bp, Amaranthus rudis
ggcaacacctgatacataattaccaccaagaaacaacccctttagcccagcatttgccaaaccagcttttgcagcatctagcagatcaaagtgaccaactaaaaattgggggattgcctttggccatactctcactcccagaacacggctgcctttcgcatttggatttatcagaatttttctgagatccttatcaactg

SEQ ID NO: 578 - DNA, 200 bp, Amaranthus spinosus
agagagagtgcaagagagatgagtgccatggcgttatcgagcagcattctacaatgtccgccgcactccgacttctctttccgcttttctgcttatacaccaacccgctcccccttcttcttcggaagacctccaaaattatcatatatccattgttccacaagctcaagctcaactgccaattaccagaacacgattac

SEQ ID NO: 579 - DNA, 200 bp, Amaranthus spinosus
gtaatcgtgttctggtaattggcagttgagcttgagcttgtggaacaatggatatatgataattttggaggtcttccgaagaagaagggggagcgggttggtgtataagcagaaaagcggaaagagaagtcggagtgcggcggacattgtagaatgctgctcgataacgccatggcactcatctctcttgcactctctct

SEQ ID NO: 580 - DNA, 200 bp, Amaranthus spinosus
ctgccaattaccagaacacgattacgacccaaggagaaggagataaagtattggattgtgtaattgttggagctggtatcagtggactttgcattgctcaagctctttctaccaaacacattcaatccaatctcaatttcattgtcactgaagctaaaaaccgtgttggaggtaatatcactaccatggagtccgatggc

SEQ ID NO: 581 - DNA, 200 bp, Amaranthus spinosus
gccatcggactccatggtagtgatattacctccaacacggtttttagcttcagtgacaatgaaattgagattggattgaatgtgtttggtagaaagagcttgagcaatgcaaagtccactgataccagctccaacaattacacaatccaatactttatctccttctccttgggtcgtaatcgtgttctggtaattggcag

SEQ ID NO: 582 - DNA, 200 bp, Amaranthus spinosus
tatcactaccatggagtccgatggctatatctgggaagagggtcctaatagtttccaaccctccgatcctgtgcttactatggcggttgacagtggattgaaagatgatttggtcttgggagatcctaatgcccctcgtttcgtgctctggaatggtaaattaaggcctgttccttccaaacctacggaccttccctttt

SEQ ID NO: 583 - DNA, 200 bp, Amaranthus spinosus
aaaagggaaggtccgtaggtttggaaggaacaggccttaatttaccattccagagcacgaaacgaggggcattaggatctcccaagaccaaatcatctttcaatccactgtcaaccgccatagtaagcacaggatcggagggttggaaactattaggaccctcttcccagatatagccatcggactccatggtagtgata

SEQ ID NO: 584 - DNA, 200 bp, Amaranthus spinosus
tccaaacctacggaccttcccttttttgatctcatgagctttcctggtaagattagggctggtcttggtgctcttggtcttcgtcctcctcctccttcttatgaggagtctgttgaagaatttgtgcgccgtaatctcggtgatgaggttttcgaacgcttgattgaacccttttgttctggtgtgtatgctggtgatcc

SEQ ID NO: 585 - DNA, 200 bp, Amaranthus spinosus
ggatcaccagcatacacaccagaacaaaagggttcaatcaagcgttcgaaaacctcatcaccgagattacggcgcacaaattcttcaacagactcctcataagaaggaggaggaggacgaagaccaagagcaccaagaccagccctaatcttaccaggaaagctcatgagatcaaaaaagggaaggtccgtaggtttgga

SEQ ID NO: 586 - DNA, 200 bp, Amaranthus spinosus
gttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaacctaagggccagactgttggatcctttaggaaa

SEQ ID NO: 587 - DNA, 200 bp, Amaranthus spinosus
tttcctaaaggatccaacagtctggcccttaggtttaggaaggcgggggtctcgaggcggtggaggattattcttcctttcctgaatagttttgagtgtaccggcgatgatactaccacccttttgctctaaggtccagacctttccaaatgcagctttcatactcaactttgaaggatcaccagcatacacaccagaac

SEQ ID NO: 588 - DNA, 200 bp, Amaranthus spinosus
ccagactgttggatcctttaggaaagggctcattatgttacctaccgccattgctgctaggcttggcagtaaagtcaaactatcatggacactttctaatattgataagtcgctcaatggtgaatacaatctcacttatcaaacacccgatggaccggtttctgttaggaccaaagcggttgtcatgactgtcccttcat

SEQ ID NO: 589 - DNA, 200 bp, Amaranthus spinosus
atgaagggacagtcatgacaaccgctttggtcctaacagaaaccggtccatcgggtgtttgataagtgagattgtattcaccattgagcgacttatcaatattagaaagtgtccatgatagtttgactttactgccaagcctagcagcaatggcggtaggtaacataatgagccctttcctaaaggatccaacagtctgg

SEQ ID NO: 590 - DNA, 200 bp, Amaranthus spinosus
gcggttgtcatgactgtcccttcatacattgcaagtagcctgcttcgtccgctctcagatgttgctgcagattctctttctaaattttactatccaccagtcgcagcagtgtccctttcttatcccaaagaagcaattagaccagaatgcttgatcgatggagaactaaaaggattcgggcaattgcatccccgcagcca

SEQ ID NO: 591 - DNA, 200 bp, Amaranthus spinosus
tggctgcggggatgcaattgcccgaatccttttagttctccatcgatcaagcattctggtctaattgcttctttgggataagaaagggacactgctgcgactggtggatagtaaaatttagaaagagaatctgcagcaacatctgagagcggacgaagcaggctacttgcaatgtatgaagggacagtcatgacaaccgc

SEQ ID NO: 592 - DNA, 200 bp, Amaranthus spinosus
tcgggcaattgcatccccgcagccagggtgtggaaaccttgggaacaatttatagttcatctcttttccctggtcgagcaccacccggtaggaccttgatcttgagctacattggaggtgctacaaatgttggcatattacaaaagagtgaagatgaacttgcggagacagttgacaaggatctcagaaaaattctgata

SEQ ID NO: 593 - DNA, 200 bp, Amaranthus spinosus
tatcagaatttttctgagatccttgtcaactgtctccgcaagttcatcttcactcttttgtaatatgccaacatttgtagcacctccaatgtagctcaagatcaaggtcctaccgggtggtgctcgaccagggaaaagagatgaactataaattgttcccaaggtttccacaccctggctgcggggatgcaattgcccga

SEQ ID NO: 594 - DNA, 200 bp, Amaranthus thunbergii
agagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaacacgattacga

SEQ ID NO: 595 - DNA, 200 bp, Amaranthus thunbergii
tcgtaatcgtgttctggtaattggcagttgagcttgagcttgtggaacaatggatatatgataattttcgtggtcttccgaagaagatgggggagtgggttggtgaatgagcagaaaagcggaacgagatgtcggagtgcggcggacattgtagaatgctgctcgataacgccatcgcactcatttctctcgcactctct

SEQ ID NO: 596 - DNA, 200 bp, Amaranthus thunbergii
gccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatatcactaccatggagtccgatggcta

SEQ ID NO: 597 - DNA, 200 bp, Amaranthus thunbergii
tagccatcggactccatggtagtgatattacctccaacacgatgtttagcttcagtgacaatgaaattgagattggattgaatgtgtttggtagaaagagcctgcgcaatgcaaagtccactgataccagctccaacaattacacaatctaatactttatctccttctccttgggtcgtaatcgtgttctggtaattggc

SEQ ID NO: 598 - DNA, 200 bp, Amaranthus thunbergii
tcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttccctttttt

SEQ ID NO: 599 - DNA, 200 bp, Amaranthus thunbergii
aaaaaagggaaggtccgtaggtttggaaggaacaggccttaatttaccattccagagcacgaaacgaggggcattaggatctcccaagaccaaatcgtctttcaatccactgtcaaccgccatagtaagcacaggatcagagggttggaaactattaggaccctcttcccagatatagccatcggactccatggtagtga

SEQ ID NO: 600 - DNA, 200 bp, Amaranthus thunbergii
caaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtg

SEQ ID NO: 601 - DNA, 200 bp, Amaranthus thunbergii
caccagcatacacaccagaacaaaagggttcgatcaagcgttcgaagacctcatcgccgagattacggcgcacaaattcttcaacagattcctcataagaagaaggaggaggaggacgacgaagaccaagtgcaccaagaccagccctaatcttaccaggaaagctcatgagatcaaaaaagggaaggtccgtaggtttg

SEQ ID NO: 602 - DNA, 200 bp, Amaranthus thunbergii
ttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttag

SEQ ID NO: 603 - DNA, 200 bp, Amaranthus thunbergii
ctaaaggatccaacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgtaggatcaccagcatacacaccagaacaaaa

SEQ ID NO: 604 - DNA, 200 bp, Amaranthus thunbergii
agggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtccct

SEQ ID NO: 605 - DNA, 200 bp, Amaranthus thunbergii
agggacagtcatgacaaccgctttggtcctaacagaaaccggtccatcgggtgtttgataagtgagaatgtattcaccattgagcgacttatcaatattagaaagtgtccacgatagtttgactttactgccaagcctagcagcaatggcggtaggtaacataatgagccctttcctaaaggatccaacagtctggccct

SEQ ID NO: 606 - DNA, 200 bp, Amaranthus thunbergii
caaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgca

SEQ ID NO: 607 - DNA, 200 bp, Amaranthus thunbergii
tgcggggatgcaattgcccgaatccttttagttctccatcgatcaagcattctggtctaattgcttctttgggataagaaagggacactgctgcgactggtggatagtaaaacttagaaagagaatctgcagcaacatctgagagcggacgaagcaggctacttgcaatgtatgaagggacagtcatgacaaccgctttg

SEQ ID NO: 608 - DNA, 200 bp, Amaranthus thunbergii
ggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattct

SEQ ID NO: 609 - DNA, 200 bp, Amaranthus thunbergii
agaatttttctgagatccttatcaactgtctccgcaagttcatcttcactcttttgtaatattccaacatttgtagcacctccaatgtagctcaagatcaaggtcctaccgggtggtgctcgaccagggaaaagagatgaactataaattgttcccaaggtttccacaccctggctgcggggatgcaattgcccgaatcc

SEQ ID NO: 610 - DNA, 200 bp, Amaranthus viridis
ggataaccagagagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaac

SEQ ID NO: 611 - DNA, 200 bp, Amaranthus viridis
gttctggtaattggcagttgagcttgagcttgtggaacaatggatatatgataattttcgtggtcttccgaagaagatgggggagtgggttggtgaatgagcagaaaagcggaacgagatgtcggagtgcggcggacattgtagaatgctgctcgataacgccatcgcactcatttctctcgcactctctctggttatcc

SEQ ID NO: 612 - DNA, 200 bp, Amaranthus viridis
aagctcaactgccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatattactaccatggagt

SEQ ID NO: 613 - DNA, 200 bp, Amaranthus viridis
actccatggtagtaatattacctccaacacgatgtttagcttcagtgacaatgaaattgagattggattgaatgtgtttggtagaaagagcctgcgcaatgcaaagtccactgataccagctccaacaattacacaatctaatactttatctccttctccttgggtcgtaatcgtgttctggtaattggcagttgagctt

SEQ ID NO: 614 - DNA, 200 bp, Amaranthus viridis
ggaggtaatattactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggacct

SEQ ID NO: 615 - DNA, 200 bp, Amaranthus viridis
aggtccgtaggtttggaaggaacaggccttaatttaccattccagagcacgaaacgaggggcattaggatctcccaagaccaaatcgtctttcaatccactgtcaaccgccatagtaagcacaggatcagagggttggaaactattaggaccctcttcccagatatagccatcggactccatggtagtaatattacctcc

SEQ ID NO: 616 - DNA, 200 bp, Amaranthus viridis
ctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtg

SEQ ID NO: 617 - DNA, 200 bp, Amaranthus viridis
cacaccagaacaaaagggttcgatcaagcgttcgaagacctcatcgccgagattacggcgcacaaattcttcaacagattcctcataagaagaaggaggaggaggacgacgaagaccaagtgcaccaagaccagccctaatcttaccaggaaagctcatgagatcaaaaaagggaaggtccgtaggtttggaaggaacag

SEQ ID NO: 618 - DNA, 200 bp, Amaranthus viridis
gatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttg

SEQ ID NO: 619 - DNA, 200 bp, Amaranthus viridis
caacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgtaggatcaccagcatacacaccagaacaaaagggttcgatc

SEQ ID NO: 620 - DNA, 200 bp, Amaranthus viridis
cctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcat

SEQ ID NO: 621 - DNA, 200 bp, Amaranthus viridis
atgacaaccgctttggtcctaacagaaaccggtccatcgggtgtttgataagtgagattgtattcaccattgagcgacttatcaatattagaaagtgtccacgatagtttgactttactgccaagcctagcagcaatggcggtaggtaacataatgagccctttcctaaaggatccaacagtctggcccttaggtttagg

SEQ ID NO: 622 - DNA, 200 bp, Amaranthus viridis
ctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattg

SEQ ID NO: 623 - DNA, 200 bp, Amaranthus viridis
caattgcccgaatccttttagttctccatcgatcaagcattctggtctaattgcttctttgggataagaaagggacactgctgcgactggtggatagtaaaacttagaaagagaatctgcagcaacatctgagagcggacgaagcaggctacttgcaatgtatgaagggacagtcatgacaaccgctttggtcctaacag

SEQ ID NO: 624 - DNA, 200 bp, Amaranthus viridis
agaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctca

SEQ ID NO: 625 - DNA, 200 bp, Amaranthus viridis
tgagatccttatcaactgtctccgcaagttcatcttcactcttttgtaatattccaacatttgtagcacctccaatgtagctcaagatcaaggtcctaccgggtggtgctcgaccagggaaaagagatgaactataaattgttcccaaggtttccacaccctggctgcggggatgcaattgcccgaatccttttagttct

SEQ ID NO: 626 - DNA, 200 bp, Amaranthus viridis
gcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcagg

SEQ ID NO: 627 - DNA, 200 bp, Amaranthus viridis
cctgatacataattaccaccaagaaacaacccctttagcccagcatttgccaaaccagcttttgcagcatctagcagatcaaagtgaccaactaaaaattgggggattgcctttggccatactctcactcccagaacacggctgcctttcgcatttggatttatcagaatttttctgagatccttatcaactgtctccgc

SEQ ID NO: 628 - DNA, 200 bp, Amaranthus viridis
ttcttggtggtaattatgtatcaggtgttgccttggggaggtgtatagagggtgcttatgactctgcatctcaggtagtggatttcctctcacagtacaaagacaagtagtcaatagggctccaccttcctggttaactaacttttgtagctcttgtaatttgtatcatgtaatattattcagatgtaaaagatacagtc

SEQ ID NO: 629 - DNA, 200 bp, Amaranthus viridis
gactgtatcttttacatctgaataatattacatgatacaaattacaagagctacaaaagttagttaaccaggaaggtggagccctattgactacttgtctttgtactgtgagaggaaatccactacctgagatgcagagtcataagcaccctctatacacctccccaaggcaacacctgatacataattaccaccaagaa

SEQ ID NO: 630 - DNA, 200 bp, Ambrosia trifida
atcccaccgcttttgcgctttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagca

SEQ ID NO: 631 - DNA, 200 bp, Ambrosia trifida
tgctttcccaacagagagccctcctttgtggttacctaatatatttagggttaattgtcatgaaataccttccatattggtcattatattttactaaattttagtcattaaactcgatagaagcttggttttaaaaagcgcgaagcgcactaaagcgacgaggtccaaaaccgaggcgcaaagcgcaaaagcggtgggat

SEQ ID NO: 632 - DNA, 200 bp, Ambrosia trifida
aggagggctctctgttgggaaagcaatatcctccggatgcaaagcagccgaatccgtgattgcatatttggattcttattcggaccagaagtagaaggatgggtgttgctagattatgttttaaccggtaaactttatttcttatatcttatttttattcttatttttcaatgcaaagagtcaaacgacgcaagtgtgat

SEQ ID NO: 633 - DNA, 200 bp, Ambrosia trifida
atcacacttgcgtcgtttgactctttgcattgaaaaataagaataaaaataagatataagaaataaagtttaccggttaaaacataatctagcaacacccatccttctacttctggtccgaataagaatccaaatatgcaatcacggattcggctgctttgcatccggaggatattgctttcccaacagagagccctcct

SEQ ID NO: 634 - DNA, 200 bp, Ambrosia trifida
cgcacgcaatggttttgcacttttgcccacagtaaagaaaaggtagcctctctacccgacccgacccgacccgaaccaaaccgataaaaacaaataccaactctgataaccagattactcacagagaaaccaacaatggcttcaccaactatagttgacaaccaaagttagggttcttctaaattctaattacattttat

SEQ ID NO: 635 - DNA, 200 bp, Ambrosia trifida
ataaaatgtaattagaatttagaagaaccctaactttggttgtcaactatagttggtgaagccattgttggtttctctgtgagtaatctggttatcagagttggtatttgtttttatcggtttggttcgggtcgggtcgggtcgggtagagaggctaccttttctttactgtgggcaaaagtgcaaaaccattgcgtgcg

SEQ ID NO: 636 - DNA, 200 bp, Ambrosia trifida
cttctaaattctaattacattttatcctaattttacttacacatttgtagcatttgcatctataattcagaaacctaatctaatttattaattaattaattaagtggttttgttttctctacagaacctgctaagagagttgctgttgttggtgctggtgtcaggtacttaaacttaaaacctaaaacagataattattt

SEQ ID NO: 637 - DNA, 200 bp, Ambrosia trifida
aaataattatctgttttaggttttaagtttaagtacctgacaccagcaccaacaacagcaactctcttagcaggttctgtagagaaaacaaaaccacttaattaattaattaataaattagattaggtttctgaattatagatgcaaatgctacaaatgtgtaagtaaaattaggataaaatgtaattagaatttagaag

SEQ ID NO: 638 - DNA, 200 bp, Ambrosia trifida
taaaacctaaaacagataattattttgcttatttactagattcacttattctgttcatgtaatttgctaaggtttgatcagtcaattatatacatttagggatttaggagttacagaatgttttgatataataatatatacaatttgtaaaaatatatagatcatgattgataattagaggaatggaatattttgataat

SEQ ID NO: 639 - DNA, 200 bp, Ambrosia trifida
attatcaaaatattccattcctctaattatcaatcatgatctatatatttttacaaattgtatatattattatatcaaaacattctgtaactcctaaatccctaaatgtatataattgactgatcaaaccttagcaaattacatgaacagaataagtgaatctagtaaataagcaaaataattatctgttttaggtttta

SEQ ID NO: 640 - DNA, 200 bp, Ambrosia trifida
tagaggaatggaatattttgataattgaaaaaacaatatgttacatttttttcagtggttgtgctgctgcttataagttaaagttacatggattgaatgtgactgtgtttgaagctgatgggagcgttggtgggaaactaaagagcgtttcgcaagatggtttaatatgggatgagggtgccaatactatggtatgtttt

SEQ ID NO: 641 - DNA, 200 bp, Ambrosia trifida
aaaacataccatagtattggcaccctcatcccatattaaaccatcttgcgaaacgctctttagtttcccaccaacgctcccatcagcttcaaacacagtcacattcaatccatgtaactttaacttataagcagcagcacaaccactgaaaaaaatgtaacatattgttttttcaattatcaaaatattccattcctcta

SEQ ID NO: 642 - DNA, 200 bp, Ambrosia trifida
gggtgccaatactatggtatgttttagtataatatgattggtttcactttgttagcattttttatgaggtttgttgtatgtgttaccttatgtagactgagagtgaggcagatgttagcagtttgattgatgatcttgggcttcgagataaacagcagtttgtaagttgttgtgtttgatatagctgccatacttcctat

SEQ ID NO: 643 - DNA, 200 bp, Ambrosia trifida
ataggaagtatggcagctatatcaaacacaacaacttacaaactgctgtttatctcgaagcccaagatcatcaatcaaactgctaacatctgcctcactctcagtctacataaggtaacacatacaacaaacctcataaaaaatgctaacaaagtgaaaccaatcatattatactaaaacataccatagtattggcaccc

SEQ ID NO: 644 - DNA, 200 bp, Ambrosia trifida
ttgatatagctgccatacttcctatagcttgtgtggtaaattatatctatgaacatatgcaattattttgtaaaatgacaagaaacagattctttgttttatttgtgtatgaataatgaatagataagactaaattcatttttaggtctgcttcgatttgtcttttataatcactacgctgagttttaaatctttaacat

SEQ ID NO: 645 - DNA, 200 bp, Ambrosia trifida
atgttaaagatttaaaactcagcgtagtgattataaaagacaaatcgaagcagacctaaaaatgaatttagtcttatctattcattattcatacacaaataaaacaaagaatctgtttcttgtcattttacaaaataattgcatatgttcatagatataatttaccacacaagctataggaagtatggcagctatatcaa

SEQ ID NO: 646 - DNA, 200 bp, Ambrosia trifida
acgctgagttttaaatctttaacattatttcctgttgcagccaatttcacagcacaagcggtacattgtaagaaatggaaaacctgtattggtatggatatctcaacaccacttaactagtgatcctctatttttagtaaaattcatttactaaaaaaaggggggctgaaaaattaaaatttaatgtgaattgtgcttta

SEQ ID NO: 647 - DNA, 200 bp, Ambrosia trifida
taaagcacaattcacattaaattttaatttttcagcccccctttttttagtaaatgaattttactaaaaatagaggatcactagttaagtggtgttgagatatccataccaatacaggttttccatttcttacaatgtaccgcttgtgctgtgaaattggctgcaacaggaaataatgttaaagatttaaaactcagcgt

SEQ ID NO: 648 - DNA, 200 bp, Ambrosia trifida
aaaatttaatgtgaattgtgctttattaggtttgaatgcttaacctcatcaaagtcaaataataacatgagtagtctgttgctctggaaacccgtattgcaacccatgaaaagatccaaatcacggtttttcaaacactgttttatacttttatgtccagggaacaaaaaaccaaaatctttcctgagtgaggccttagt

SEQ ID NO: 649 - DNA, 200 bp, Ambrosia trifida
actaaggcctcactcaggaaagattttggttttttgttccctggacataaaagtataaaacagtgtttgaaaaaccgtgatttggatcttttcatgggttgcaatacgggtttccagagcaacagactactcatgttattatttgactttgatgaggttaagcattcaaacctaataaagcacaattcacattaaatttt

SEQ ID NO: 650 - DNA, 200 bp, Ambrosia trifida
aatctttcctgagtgaggccttagttgtcttcttattatttatcttttatatttatcaagttcatgtctctctatattgaccatgactcagtctatatcatgattgcagataccttctaacccaattgcactgattagcagcagttttctttccactcagtcaaaggtatgttagtagctcctgccaccttgaaggttca

SEQ ID NO: 651 - DNA, 200 bp, Ambrosia trifida
tgaaccttcaaggtggcaggagctactaacatacctttgactgagtggaaagaaaactgctgctaatcagtgcaattgggttagaaggtatctgcaatcatgatatagactgagtcatggtcaatatagagagacatgaacttgataaatataaaagataaataataagaagacaactaaggcctcactcaggaaagatt

SEQ ID NO: 652 - DNA, 200 bp, Ambrosia trifida
tagctcctgccaccttgaaggttcaagcataagtatgccatatcttattgagatcgttcactcgcatactatcttcttaatgttgttcaatgttgagattaaagtgcaatctttattctattttgcttaatcaaatataatgtttatttattttaattttattaaaaaagtatctacgtaagtattacaaaaagtaaaaa

SEQ ID NO: 653 - DNA, 200 bp, Ambrosia trifida
tttttactttttgtaatacttacgtagatacttttttaataaaattaaaataaataaacattatatttgattaagcaaaatagaataaagattgcactttaatctcaacattgaacaacattaagaagatagtatgcgagtgaacgatctcaataagatatggcatacttatgcttgaaccttcaaggtggcaggagcta

SEQ ID NO: 654 - DNA, 200 bp, Ambrosia trifida
acgtaagtattacaaaaagtaaaaactcttccccgttgatgagatgatctcaaagtctaatgtcatatatctagtactctcaataagctaacataaacagtatagtctattaaaagggtccccaacatcgaaatgagtaacgctgctttgagttaagggtgcaaaatgtcatataataaataaagatgttctatgatgct

SEQ ID NO: 655 - DNA, 200 bp, Ambrosia trifida
agcatcatagaacatctttatttattatatgacattttgcacccttaactcaaagcagcgttactcatttcgatgttggggacccttttaatagactatactgtttatgttagcttattgagagtactagatatatgacattagactttgagatcatctcatcaacggggaagagtttttactttttgtaatacttacgt

SEQ ID NO: 656 - DNA, 200 bp, Ambrosia trifida
ataaataaagatgttctatgatgctttgatatttgtttcgcactttcacttatcccccatggtatttttaacttgtttttaaaagtagaagattttttttattgatgtgcatgcgattattatcggctttgtttgcaaattttacaggttcaaattcttttagagccatttttatggaagaagactaagtcatctgacga

SEQ ID NO: 657 - DNA, 200 bp, Ambrosia trifida
tcgtcagatgacttagtcttcttccataaaaatggctctaaaagaatttgaacctgtaaaatttgcaaacaaagccgataataatcgcatgcacatcaataaaaaaaatcttctacttttaaaaacaagttaaaaataccatgggggataagtgaaagtgcgaaacaaatatcaaagcatcatagaacatctttatttat

SEQ ID NO: 658 - DNA, 200 bp, Ambrosia trifida
ggaagaagactaagtcatctgacgaacccgagaggtaaaatacatagccttgttccatttcatcggcttgaagtagttatattcggtacatgccattaggttcttaaccatgtattttgcagtgttggaggattctttcaacgtcattttgggaaggaggtgtttgtatattcgacataatgttttgtttctgttctgat

SEQ ID NO: 659 - DNA, 200 bp, Ambrosia trifida
atcagaacagaaacaaaacattatgtcgaatatacaaacacctccttcccaaaatgacgttgaaagaatcctccaacactgcaaaatacatggttaagaacctaatggcatgtaccgaatataactacttcaagccgatgaaatggaacaaggctatgtattttacctctcgggttcgtcagatgacttagtcttcttcc

SEQ ID NO: 660 - DNA, 200 bp, Ambrosia trifida
cataatgttttgtttctgttctgattctgtttctcatagttattaatatttgacctgcttatctaaggttgttgagtatctcattgatccagttgttgcgggaacaagcggtggagatcctgaatcactctctgtgagtaactattgtttctccacacatttttttggagaaatatacattgctgctttacattaacgac

SEQ ID NO: 661 - DNA, 200 bp, Ambrosia trifida
gtcgttaatgtaaagcagcaatgtatatttctccaaaaaaatgtgtggagaaacaatagttactcacagagagtgattcaggatctccaccgcttgttcccgcaacaactggatcaatgagatactcaacaaccttagataagcaggtcaaatattaataactatgagaaacagaatcagaacagaaacaaaacattatg

SEQ ID NO: 662 - DNA, 200 bp, Ambrosia trifida
tacattgctgctttacattaacgaccttaaaccgtttaatatattgcttgaattcttttacttttccacacagatgcgtcatgcatttcctgagctatgggatttagagagaaggtatgtttgtaacaaacagtagtaattcttcttcaaacgatctgtggaataatgacttttgaccacttatttctgaagacctaaaa

SEQ ID NO: 663 - DNA, 200 bp, Ambrosia trifida
ttttaggtcttcagaaataagtggtcaaaagtcattattccacagatcgtttgaagaagaattactactgtttgttacaaacataccttctctctaaatcccatagctcaggaaatgcatgacgcatctgtgtggaaaagtaaaagaattcaagcaatatattaaacggtttaaggtcgttaatgtaaagcagcaatgta

SEQ ID NO: 664 - DNA, 200 bp, Ambrosia trifida
accacttatttctgaagacctaaaatcaatttaatacttacaactatttaattcaggtttggttcaatcatttctggggcatttcaatctatggtatcttccagaggtgggaaaaggaaaccttctggaaacagcaaacgtaggcgtggttccttttctttttttggtgggatgcaggtaagacgagggtgatttactga

SEQ ID NO: 665 - DNA, 200 bp, Ambrosia trifida
tcagtaaatcaccctcgtcttacctgcatcccaccaaaaaaagaaaaggaaccacgcctacgtttgctgtttccagaaggtttccttttcccacctctggaagataccatagattgaaatgccccagaaatgattgaaccaaacctgaattaaatagttgtaagtattaaattgattttaggtcttcagaaataagtggt

SEQ ID NO: 666 - DNA, 200 bp, Ambrosia trifida
aggtaagacgagggtgatttactgatttagataagaccctaaatttagttattgttatcttttaattaattacagatgttatttgggtcgttcatgcttttttgctatgcagacactcactgatgcactatgcaaagagattggaccccatgaagttaatcttcaatcaaaggtgcttgaaatgtcctacagctgcgatg

SEQ ID NO: 667 - DNA, 200 bp, Ambrosia trifida
catcgcagctgtaggacatttcaagcacctttgattgaagattaacttcatggggtccaatctctttgcatagtgcatcagtgagtgtctgcatagcaaaaaagcatgaacgacccaaataacatctgtaattaattaaaagataacaataactaaatttagggtcttatctaaatcagtaaatcaccctcgtcttacct

SEQ ID NO: 668 - DNA, 200 bp, Ambrosia trifida
cttgaaatgtcctacagctgcgatgataatgcggttggtaattggtcaatttattgtgctccagatcaaaacaaacaatttcagcaatcttttgatgctgtgatcatgactgtgagtgccttcattgggtaatcttttacttatcagtgacataaagttagttaatttcttgcattcttgatgaagatagttttttgtat

SEQ ID NO: 669 - DNA, 200 bp, Ambrosia trifida
atacaaaaaactatcttcatcaagaatgcaagaaattaactaactttatgtcactgataagtaaaagattacccaatgaaggcactcacagtcatgatcacagcatcaaaagattgctgaaattgtttgttttgatctggagcacaataaattgaccaattaccaaccgcattatcatcgcagctgtaggacatttcaag

SEQ ID NO: 670 - DNA, 200 bp, Ambrosia trifida
tcttgatgaagatagttttttgtatctttaaagtttattctgtgtcctctaggtagtatctggatattaatacatgggatgggaatttttttaatcttgagtttttctctgatggttattaagtgttagatgcatctaattttaactgacaaagaaaatattccccaattaggccccacttaacaatgtaaaagaaatga

SEQ ID NO: 671 - DNA, 200 bp, Ambrosia trifida
tcatttcttttacattgttaagtggggcctaattggggaatattttctttgtcagttaaaattagatgcatctaacacttaataaccatcagagaaaaactcaagattaaaaaaattcccatcccatgtattaatatccagatactacctagaggacacagaataaactttaaagatacaaaaaactatcttcatcaaga

SEQ ID NO: 672 - DNA, 200 bp, Ambrosia trifida
ccacttaacaatgtaaaagaaatgaagattacaaagacaggaagtccgtttctgcttaattttattccagaggtatgtttttttttcttctactaaagcattagttttagttctatcaaatctaacactgaatacagaaaacagctttaacatcgtcatccaattaaattgtgaaatatttatagtgtcatttcttagcc

SEQ ID NO: 673 - DNA, 200 bp, Ambrosia trifida
ggctaagaaatgacactataaatatttcacaatttaattggatgacgatgttaaagctgttttctgtattcagtgttagatttgatagaactaaaactaatgctttagtagaagaaaaaaaaacatacctctggaataaaattaagcagaaacggacttcctgtctttgtaatcttcatttcttttacattgttaagtgg

SEQ ID NO: 674 - DNA, 200 bp, Ambrosia trifida
atatttatagtgtcatttcttagccttttgtttttataatacaggtgagttatttgccattatcagtaataatctccactttcaagaaagaaaacgtgaagcagcctcttgagggttttggagttcttgttcctgccaaggagcaggaaaatggtttgaggacactaggtgaagcttgattctgccctccattattgttt

SEQ ID NO: 675 - DNA, 200 bp, Ambrosia trifida
aaacaataatggagggcagaatcaagcttcacctagtgtcctcaaaccattttcctgctccttggcaggaacaagaactccaaaaccctcaagaggctgcttcacgttttctttcttgaaagtggagattattactgataatggcaaataactcacctgtattataaaaacaaaaggctaagaaatgacactataaatat

SEQ ID NO: 676 - DNA, 200 bp, Ambrosia trifida
ttgattctgccctccattattgttttttatttgtttacattgacaccatagcaaaaattctgctatgcaggcaccctcttctcttccatgatgtttccagatcgggcctcagaagacgtgtacctttacaccacctttgttgggggtagtcgaaacaaagaactggccaaagcttcgaggtaggcaggcttgctcatcac

SEQ ID NO: 677 - DNA, 200 bp, Ambrosia trifida
gtgatgagcaagcctgcctacctcgaagctttggccagttctttgtttcgactacccccaacaaaggtggtgtaaaggtacacgtcttctgaggcccgatctggaaacatcatggaagagaagagggtgcctgcatagcagaatttttgctatggtgtcaatgtaaacaaataaaaaacaataatggagggcagaatcaa

SEQ ID NO: 678 - DNA, 200 bp, Ambrosia trifida
cgaggtaggcaggcttgctcatcaccatattcccccttaaaattgtagtgtgaacttaactcaagttctaattaattttttgtgcatatgttcaaaatctatgatagccttctgaaagacaaagtaaaaaaagtctttactgattaattgtggtaaaatcaatttattcataatgacgttaattgacaaataggtcttgg

SEQ ID NO: 679 - DNA, 200 bp, Ambrosia trifida
ccaagacctatttgtcaattaacgtcattatgaataaattgattttaccacaattaatcagtaaagactttttttactttgtctttcagaaggctatcatagattttgaacatatgcacaaaaaattaattagaacttgagttaagttcacactacaattttaagggggaatatggtgatgagcaagcctgcctacctcg

SEQ ID NO: 680 - DNA, 200 bp, Ambrosia trifida
acgttaattgacaaataggtcttggaaactttcctagtagaggatatgttgtaacttttaactcaaaaatctttcttgcaaaatagggacgagttgaagcagatagtaacttctgacctcagacagttgcttggaacagaaggggagccaaaatttctaacgtaagggcacaacgctatttcagtttaacagtaatcttt

SEQ ID NO: 681 - DNA, 200 bp, Ambrosia trifida
aaagattactgttaaactgaaatagcgttgtgcccttacgttagaaattttggctccccttctgttccaagcaactgtctgaggtcagaagttactatctgcttcaactcgtccctattttgcaagaaagatttttgagttaaaagttacaacatatcctctactaggaaagtttccaagacctatttgtcaattaacgt

SEQ ID NO: 682 - DNA, 200 bp, Ambrosia trifida
ctatttcagtttaacagtaatctttgctagaataagaaatgtaaccgcttgcctacctatggtctttttatctgttaaacaaaattttgtttaataaccactagcctggtgtagtggcaaaggtgtatctccctcatccaagaggtgttgggttctagtctcacttgagacaaggggaacattataagcggagtaaaaaa

SEQ ID NO: 683 - DNA, 200 bp, Ambrosia trifida
ttttttactccgcttataatgttccccttgtctcaagtgagactagaacccaacacctcttggatgagggagatacacctttgccactacaccaggctagtggttattaaacaaaattttgtttaacagataaaaagaccataggtaggcaagcggttacatttcttattctagcaaagattactgttaaactgaaatag

SEQ ID NO: 684 - DNA, 200 bp, Ambrosia trifida
ggaacattataagcggagtaaaaaattagccgtttaaaaaaaaaaaagtttgtaatttgaagttttccatcatgaactgaaacagttgctaaaatgtaacaagaagttattaaagtcttgaggtacatagatatatacacaatgtaaatatggcttacggagttgtgaggttgattgcagtcactattattggagcaaag

SEQ ID NO: 685 - DNA, 200 bp, Ambrosia trifida
ctttgctccaataatagtgactgcaatcaacctcacaactccgtaagccatatttacattgtgtatatatctatgtacctcaagactttaataacttcttgttacattttagcaactgtttcagttcatgatggaaaacttcaaattacaaacttttttttttttaaacggctaattttttactccgcttataatgttcc

SEQ ID NO: 686 - DNA, 200 bp, Ambrosia trifida
tgcagtcactattattggagcaaagcatttccattgtatgggcgtgactatggttcagttattgaagcaattgagaagatggaaaaagagctacccggttacttttatgcaggtaacatgttttgtcttgaaaataaaaatggacaaatcatatgttgatgagtagaggtggcaattttgacctattataacttacagag

SEQ ID NO: 687 - DNA, 200 bp, Ambrosia trifida
ctctgtaagttataataggtcaaaattgccacctctactcatcaacatatgatttgtccatttttattttcaagacaaaacatgttacctgcataaaagtaaccgggtagctctttttccatcttctcaattgcttcaataactgaaccatagtcacgcccatacaatggaaatgctttgctccaataatagtgactgca

SEQ ID NO: 688 - DNA, 200 bp, Ambrosia trifida
gactgacagagaaaccaacaatggcttcaccaactatagttgacaaccaaaaacctgctaagagagttgctgttgttggtgctggtgtcagtggttgtgctgctgcttataagttaaagttacatggattgaatgtgactgtgtttgaagctgatgggagcgttggtgggaaactaaagagcgtttcgcaagatggttta

SEQ ID NO: 689 - DNA, 200 bp, Ambrosia trifida
taaaccatcttgcgaaacgctctttagtttcccaccaacgctcccatcagcttcaaacacagtcacattcaatccatgtaactttaacttataagcagcagcacaaccactgacaccagcaccaacaacagcaactctcttagcaggtttttggttgtcaactatagttggtgaagccattgttggtttctctgtcagtc

SEQ ID NO: 690 - DNA, 200 bp, Ambrosia trifida
aaagagcgtttcgcaagatggtttaatatgggatgagggtgccaatactatgactgagagtgaggcagatgttagcagtttgattgatgatcttgggcttcgagataaacagcagtttccaatttcacagcacaagcggtacattgtaagaaatggaaaacctgtattgataccttctaacccaattgcactgattagca

SEQ ID NO: 691 - DNA, 200 bp, Ambrosia trifida
tgctaatcagtgcaattgggttagaaggtatcaatacaggttttccatttcttacaatgtaccgcttgtgctgtgaaattggaaactgctgtttatctcgaagcccaagatcatcaatcaaactgctaacatctgcctcactctcagtcatagtattggcaccctcatcccatattaaaccatcttgcgaaacgctcttt

SEQ ID NO: 692 - DNA, 200 bp, Ambrosia trifida
tctaacccaattgcactgattagcagcagttttctttccactcagtcaaaggttcaaattcttttagagccatttttatggaagaagactaagtcatctgacgaacccgagagtgttggaggattctttcaacgtcattttgggaaggaggttgttgagtatctcattgatccagttgttgcgggaacaagcggtggaga

SEQ ID NO: 693 - DNA, 200 bp, Ambrosia trifida
tctccaccgcttgttcccgcaacaactggatcaatgagatactcaacaacctccttcccaaaatgacgttgaaagaatcctccaacactctcgggttcgtcagatgacttagtcttcttccataaaaatggctctaaaagaatttgaacctttgactgagtggaaagaaaactgctgctaatcagtgcaattgggttaga

SEQ ID NO: 694 - DNA, 200 bp, Ambrosia trifida
ttgttgcgggaacaagcggtggagatcctgaatcactctctatgcgtcatgcatttcctgagctatgggatttagagagaaggtttggttcaatcatttctggggcatttcaatctatggtatcttccagaggtgggaaaaggaaaccttctggaaacagcaaacgtaggcgtggttccttttctttttttggtgggatg

SEQ ID NO: 695 - DNA, 200 bp, Ambrosia trifida
catcccaccaaaaaaagaaaaggaaccacgcctacgtttgctgtttccagaaggtttccttttcccacctctggaagataccatagattgaaatgccccagaaatgattgaaccaaaccttctctctaaatcccatagctcaggaaatgcatgacgcatagagagtgattcaggatctccaccgcttgttcccgcaacaa

SEQ ID NO: 696 - DNA, 200 bp, Ambrosia trifida
ttccttttctttttttggtgggatgcagacactcactgatgcactatgcaaagagattggaccccatgaagttaatcttcaatcaaaggtgcttgaaatgtcctacagctgcgatgataatgcggttggtaattggtcaatttattgtgctccagatcaaaacaaacaatttcagcaatcttttgatgctgtgatcatga

SEQ ID NO: 697 - DNA, 200 bp, Ambrosia trifida
tcatgatcacagcatcaaaagattgctgaaattgtttgttttgatctggagcacaataaattgaccaattaccaaccgcattatcatcgcagctgtaggacatttcaagcacctttgattgaagattaacttcatggggtccaatctctttgcatagtgcatcagtgagtgtctgcatcccaccaaaaaaagaaaaggaa

SEQ ID NO: 698 - DNA, 200 bp, Ambrosia trifida
ggaacatcaaccagataagactttcccccaataaaaatgtcatctctcacaaacctcccttccctgaaccactaccgcacctggtcttccccacccattccccatcgaacccaatcatccaaaccccctaaccacctaaccacctatggtcccaccaataacaaccacaacagacgtacaacaacaaccttccgttgctc

SEQ ID NO: 699 - DNA, 200 bp, Ambrosia trifida
gagcaacggaaggttgttgttgtacgtctgttgtggttgttattggtgggaccataggtggttaggtggttagggggtttggatgattgggttcgatggggaatgggtggggaagaccaggtgcggtagtggttcagggaagggaggtttgtgagagatgacatttttattgggggaaagtcttatctggttgatgttcc

SEQ ID NO: 700 - DNA, 200 bp, Ambrosia trifida
gtacaacaacaaccttccgttgctcaatagccaacgacactccaatctctcctccaattaccaacgactccaattctaaacccttactggactgtgttattattggtgctggaatcagtggtctctgcattgcccaagccctagctactaaacatgctgacgtgtcacctgatgtggttgttacggaagcacgtgatagg

SEQ ID NO: 701 - DNA, 200 bp, Ambrosia trifida
cctatcacgtgcttccgtaacaaccacatcaggtgacacgtcagcatgtttagtagctagggcttgggcaatgcagagaccactgattccagcaccaataataacacagtccagtaagggtttagaattggagtcgttggtaattggaggagagattggagtgtcgttggctattgagcaacggaaggttgttgttgtac

SEQ ID NO: 702 - DNA, 200 bp, Ambrosia trifida
ggttgttacggaagcacgtgatagggttggaggtaatatatcgacggttgaacgtgatggatatttgtgggaagaaggtccgaatagttttcaaccgtctgatccgatgctcactatggtggtggatagtgggttgaaagatgatttggttttaggggaccccactgcaccacggtttgtattgtggggtggtggtttga

SEQ ID NO: 703 - DNA, 200 bp, Ambrosia trifida
tcaaaccaccaccccacaatacaaaccgtggtgcagtggggtcccctaaaaccaaatcatctttcaacccactatccaccaccatagtgagcatcggatcagacggttgaaaactattcggaccttcttcccacaaatatccatcacgttcaaccgtcgatatattacctccaaccctatcacgtgcttccgtaacaacc

SEQ ID NO: 704 - DNA, 200 bp, Ambrosia trifida
tttgtattgtggggtggtggtttgaagccagtgccttccagtccagctgatttgcctttctttgatctaatgagctttactggaaaactcagagccggttttggtgctctagggatccgccctccaccaccagatcgtgaggaatctgttgaagaatttgttcggcgtaaccttggtgatgaagtttttgaacgcttaat

SEQ ID NO: 705 - DNA, 200 bp, Ambrosia trifida
attaagcgttcaaaaacttcatcaccaaggttacgccgaacaaattcttcaacagattcctcacgatctggtggtggagggcggatccctagagcaccaaaaccggctctgagttttccagtaaagctcattagatcaaagaaaggcaaatcagctggactggaaggcactggcttcaaaccaccaccccacaatacaaa

SEQ ID NO: 706 - DNA, 200 bp, Ambrosia trifida
gtgatgaagtttttgaacgcttaatagaaccattttgttcaggtgtttatgctggcgacccatcaaaacttagtatgaaagcagcatttggtaaagtttggaagctggagaagaatggtggtagcattattggtggagcattcaaagcaatccaagcaaaaataagagtaccaagcctcctcgggacccgagattaccaa

SEQ ID NO: 707 - DNA, 200 bp, Ambrosia trifida
ttggtaatctcgggtcccgaggaggcttggtactcttatttttgcttggattgctttgaatgctccaccaataatgctaccaccattcttctccagcttccaaactttaccaaatgctgctttcatactaagttttgatgggtcgccagcataaacacctgaacaaaatggttctattaagcgttcaaaaacttcatcac

SEQ ID NO: 708 - DNA, 200 bp, Ambrosia trifida
cctcctcgggacccgagattaccaacaccaaagggccaaactgttggatcttttaggaagggacaagccatgttgcccaatgccatctcaaaacgtttgggtagcagagtgaaagtgtcatggaagctaataaatatctcaaagttggagaatagaggttataatctgacttacgaaacaccaaatggatttgcaagtct

SEQ ID NO: 709 - DNA, 200 bp, Ambrosia trifida
agacttgcaaatccatttggtgtttcgtaagtcagattataacctctattctccaactttgagatatttattagcttccatgacactttcactctgctacccaaacgttttgagatggcattgggcaacatggcttgtcccttcctaaaagatccaacagtttggccctttggtgttggtaatctcgggtcccgaggagg

SEQ ID NO: 710 - DNA, 200 bp, Ambrosia trifida
aaacaccaaatggatttgcaagtctgcaaactaaaactgttgtcatgactgttccttcctacgtggcgagtgacttgttgcgtcctctttcgtcggaagcagcagaggctttgtccaaattttattaccctccagttgctgctgtatctgtttcctatccaaaagaagcgattcgtgctgaccgtttgatcgatggtcaa

SEQ ID NO: 711 - DNA, 200 bp, Ambrosia trifida
ttgaccatcgatcaaacggtcagcacgaatcgcttcttttggataggaaacagatacagcagcaactggagggtaataaaatttggacaaagcctctgctgcttccgacgaaagaggacgcaacaagtcactcgccacgtaggaaggaacagtcatgacaacagttttagtttgcagacttgcaaatccatttggtgttt

SEQ ID NO: 712 - DNA, 200 bp, Ambrosia trifida
tgctgaccgtttgatcgatggtcaacttaagggttttggtcaattacatccaagaagtcaaggcgttgagactttaggtaccatctatagctcatcccttttccctaaccgggcgccacctggaagggttctcctccttaactacattggaggggctacaaatcctggtattttgtcgaagacggagagtgaacttgtgg

SEQ ID NO: 713 - DNA, 200 bp, Ambrosia trifida
ccacaagttcactctccgtcttcgacaaaataccaggatttgtagcccctccaatgtagttaaggaggagaacccttccaggtggcgcccggttagggaaaagggatgagctatagatggtacctaaagtctcaacgccttgacttcttggatgtaattgaccaaaacccttaagttgaccatcgatcaaacggtcagca

SEQ ID NO: 714 - DNA, 200 bp, Ambrosia trifida
tcgaagacggagagtgaacttgtggaagcagttgaccgtgacctaaggaagatgctcataaaccctagagcaggcgaaccgttgactttgggggtcaaagtgtggcctcgagcaatcccacagtttctaattggtcattttgacattttggatgctgcaaaatttgctcttagtgaaggtggatatagaggtatgtttct

SEQ ID NO: 715 - DNA, 200 bp, Ambrosia trifida
agaaacatacctctatatccaccttcactaagagcaaattttgcagcatccaaaatgtcaaaatgaccaattagaaactgtgggattgctcgaggccacactttgacccccaaagtcaacggttcgcctgctctagggtttatgagcatcttccttaggtcacggtcaactgcttccacaagttcactctccgtcttcga

SEQ ID NO: 716 - DNA, 200 bp, Ambrosia trifida
aaggtggatatagaggtatgtttcttggaggcaactatgtttctggtgtggctttaggtcgatgcgtggagagtgcttatgacgttgcagccgatgtaagtacatttttgtcacgaggcgtgtataagtgatactgttatgtagcactttggaatactttcttgtgaggttagtggttacctttttgtcacaaggcaggt

SEQ ID NO: 717 - DNA, 200 bp, Ambrosia trifida
acctgccttgtgacaaaaaggtaaccactaacctcacaagaaagtattccaaagtgctacataacagtatcacttatacacgcctcgtgacaaaaatgtacttacatcggctgcaacgtcataagcactctccacgcatcgacctaaagccacaccagaaacatagttgcctccaagaaacatacctctatatccacctt

SEQ ID NO: 718 - DNA, 200 bp, Ambrosia trifida
ttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagcaatatcctccggatgcaaag

SEQ ID NO: 719 - DNA, 200 bp, Ambrosia trifida
ctttgcatccggaggatattgctttcccaacagagagccctcctttgtggttacctaatatatttagggttaattgtcatgaaataccttccatattggtcattatattttactaaattttagtcattaaactcgatagaagcttggttttaaaaagcgcgaagcgcactaaagcgacgaggtccaaaaccgaggcgcaa

SEQ ID NO: 720 - DNA, 200 bp, Ambrosia trifida
aaagcaatatcctccggatgcaaagcagccgaatccgtgattgcatatttggattcttattcggaccagaagtagaaggatgggtgttgctagatgatgttttaactggtaaactttatttcttatatcttattttttttcttatttttcaatgcaaagagtcaaacggcgcaagtgtaatatcaggattggccggagaa

SEQ ID NO: 721 - DNA, 200 bp, Ambrosia trifida
ttctccggccaatcctgatattacacttgcgccgtttgactctttgcattgaaaaataagaaaaaaaataagatataagaaataaagtttaccagttaaaacatcatctagcaacacccatccttctacttctggtccgaataagaatccaaatatgcaatcacggattcggctgctttgcatccggaggatattgcttt

SEQ ID NO: 722 - DNA, 200 bp, Ambrosia trifida
tgtaatatcaggattggccggagaatgtagatcaaaagagtttttgttcgctcgaggttggataaatttgacgaaaattcagcatggcttttcgctttgtgtttttgaaggtgagcaaggatggtgttgtataaacttattgttgagtaaattataactaatgacatgtttgaataatgtgttagaaaaaaatgaatctt

SEQ ID NO: 723 - DNA, 200 bp, Ambrosia trifida
aagattcatttttttctaacacattattcaaacatgtcattagttataatttactcaacaataagtttatacaacaccatccttgctcaccttcaaaaacacaaagcgaaaagccatgctgaattttcgtcaaatttatccaacctcgagcgaacaaaaactcttttgatctacattctccggccaatcctgatattaca

SEQ ID NO: 724 - DNA, 200 bp, Ambrosia trifida
aatgtgttagaaaaaaatgaatcttataattgaaaataatatgatcaatttatgatagtgttttcatgttagatataatcaaagtatgaaatcttatatcctaagaatggttatatatggtttagtaggttaagtgtgttttgacaatgatgcataataaggatttaacttggagaaacggtgacgtggacagcttgaag

SEQ ID NO: 725 - DNA, 200 bp, Ambrosia trifida
cttcaagctgtccacgtcaccgtttctccaagttaaatccttattatgcatcattgtcaaaacacacttaacctactaaaccatatataaccattcttaggatataagatttcatactttgattatatctaacatgaaaacactatcataaattgatcatattattttcaattataagattcatttttttctaacacatt

SEQ ID NO: 726 - DNA, 200 bp, Ambrosia trifida
tttctagcaatcttttgatgctgtgatcatgactgccccacttaacaatgtaaaagaaatgaagattacaaagacaggaagtccgtttctgcttaattttattccagaggtgagttatttgccaatatcagtaataatctccactttcaagaaagaaaacgtgaagcagcctcttgagggttttggagttcttgttcctg

SEQ ID NO: 727 - DNA, 200 bp, Ambrosia trifida
caggaacaagaactccaaaaccctcaagaggctgcttcacgttttctttcttgaaagtggagattattactgatattggcaaataactcacctctggaataaaattaagcagaaacggacttcctgtctttgtaatcttcatttcttttacattgttaagtggggcagtcatgatcacagcatcaaaagattgctagaaa

SEQ ID NO: 728 - DNA, 200 bp, Ambrosia trifida
gagggttttggagttcttgttcctgccaaggagcaggaaaatggtttgaggacactaggcaccctcttctcttccatgatgtttccagatcgggcctcagaagacgtgtacctttacaccacctttgttgggggtagtcgaaacaaagaactggccaaagcttcgagggacgagttgaagcagatagtaacttctgacct

SEQ ID NO: 729 - DNA, 200 bp, Ambrosia trifida
aggtcagaagttactatctgcttcaactcgtccctcgaagctttggccagttctttgtttcgactacccccaacaaaggtggtgtaaaggtacacgtcttctgaggcccgatctggaaacatcatggaagagaagagggtgcctagtgtcctcaaaccattttcctgctccttggcaggaacaagaactccaaaaccctc

SEQ ID NO: 730 - DNA, 200 bp, Ambrosia trifida
tgaagcagatagtaacttctgacctcagacagttgcttggaacagaaggggagccaaaatttctaactcactattattggagcaaagcatttccattgtatgggcgtgactatggttcagttattgaagcaattgagaagatggaaaaagagctacccggttacttttatgcaggtaaccacaaaggagggctctctgtt

SEQ ID NO: 731 - DNA, 200 bp, Ambrosia trifida
aacagagagccctcctttgtggttacctgcataaaagtaaccgggtagctctttttccatcttctcaattgcttcaataactgaaccatagtcacgcccatacaatggaaatgctttgctccaataatagtgagttagaaattttggctccccttctgttccaagcaactgtctgaggtcagaagttactatctgcttca

SEQ ID NO: 732 - DNA, 200 bp, Ambrosia trifida
taaccacaaaggagggctctctgttgggaaagcaatatcctccggatgcaaagcagccgaatccgtgattgcatatttggattcttattcggaccagaagtagaaggatgggtgttgctagatgatgttttaactggattggccggagaatgtagatcaaaagagtttttgttcgctagagcgaggataaatttgacgaa

SEQ ID NO: 733 - DNA, 200 bp, Ambrosia trifida
ttcgtcaaatttatcctcgctctagcgaacaaaaactcttttgatctacattctccggccaatccagttaaaacatcatctagcaacacccatccttctacttctggtccgaataagaatccaaatatgcaatcacggattcggctgctttgcatccggaggatattgctttcccaacagagagccctcctttgtggtta

SEQ ID NO: 734 - DNA, 200 bp, Chenopodium album
aaccctcaaaagaaaattttcactgcaatctttgtagccttcttgttagcaaaatactcggacaactaatcctagcaacagcgctatttgtttgagtattgtgagaggtaatccactacctcagctgcagattcataagcaccctctatacatcgccccaatgcaacacctgaaacatagttgccaccaagaaacaatcc

SEQ ID NO: 735 - DNA, 200 bp, Chenopodium album
ggattgtttcttggtggcaactatgtttcaggtgttgcattggggcgatgtatagagggtgcttatgaatctgcagctgaggtagtggattacctctcacaatactcaaacaaatagcgctgttgctaggattagttgtccgagtattttgctaacaagaaggctacaaagattgcagtgaaaattttcttttgagggtt

SEQ ID NO: 736 - DNA, 200 bp, Chenopodium album
catagttgccaccaagaaacaatcccttgaacccagcatcagttagagctgcttttgcagcatcaagcagatcaaagtggccaatcaaaaattgtggaattgcttggggccatactctcacgcccaaaacccggggatcttttgcattaggatttatgagaatgtttctcaagtccttgtcaactgccccagcaagttca

SEQ ID NO: 737 - DNA, 200 bp, Chenopodium album
tgaacttgctggggcagttgacaaggacttgagaaacattctcataaatcctaatgcaaaagatccccgggttttgggcgtgagagtatggccccaagcaattccacaatttttgattggccactttgatctgcttgatgctgcaaaagcagctctaactgatgctgggttcaagggattgtttcttggtggcaactatg

SEQ ID NO: 738 - DNA, 200 bp, Chenopodium album
cttgtcaactgccccagcaagttcatcttgcgtcttgtgtaatatactagtgtttgtagaacctccaatgtaactcaaaattaaggtcctaccaggtggtgctcgaccagggaaaagcgatgaactataaattgatcccaaggtttcaacaccctgactgcggggatgcaattgcccaaatccttgaagtttaccatcaa

SEQ ID NO: 739 - DNA, 200 bp, Chenopodium album
ttgatggtaaacttcaaggatttgggcaattgcatccccgcagtcagggtgttgaaaccttgggatcaatttatagttcatcgcttttccctggtcgagcaccacctggtaggaccttaattttgagttacattggaggttctacaaacactagtatattacacaagacgcaagatgaacttgctggggcagttgacaag

SEQ ID NO: 740 - DNA, 200 bp, Chenopodium album
ccaaatccttgaagtttaccatcaatcaaacactctgatctaattgcttcactaggataagaaagtgacacagctgcaactggtggatagtagaactttgcaagtgattctgcagcaacatctgaaagtggacgaaggaggctacttgcaatatgtgatgggacagtcatcacaacacttttggtccgtacagaaaccag

SEQ ID NO: 741 - DNA, 200 bp, Chenopodium album
ctggtttctgtacggaccaaaagtgttgtgatgactgtcccatcacatattgcaagtagcctccttcgtccactttcagatgttgctgcagaatcacttgcaaagttctactatccaccagttgcagctgtgtcactttcttatcctagtgaagcaattagatcagagtgtttgattgatggtaaacttcaaggatttgg

SEQ ID NO: 742 - DNA, 200 bp, Chenopodium album
cacttttggtccgtacagaaaccagtccatctggtgtttcataagtcagattatattctccatttggcaacttaacaatactagaaagggtccatgatagtttcactttgctgccaagcctttcagaaatggctgtaggcaacatagtgagtcctttcctgaaggatccaactgtctggcccttaggtttagggaggcgc

SEQ ID NO: 743 - DNA, 200 bp, Chenopodium album
gcgcctccctaaacctaagggccagacagttggatccttcaggaaaggactcactatgttgcctacagccatttctgaaaggcttggcagcaaagtgaaactatcatggaccctttctagtattgttaagttgccaaatggagaatataatctgacttatgaaacaccagatggactggtttctgtacggaccaaaagtg

SEQ ID NO: 744 - DNA, 200 bp, Chenopodium album
ctggcccttaggtttagggaggcgcgggtctcgaggtggctttggattgttctttctttcctggattgttttgagggtaccaccaatgatactaccacccttttgttccaagatccaaactttgccaaaagcagctttcatactcaacttggaaggatcgccagcatacacgcctgaacaaaagggttcaatcaagcgtt

SEQ ID NO: 745 - DNA, 200 bp, Chenopodium album
aacgcttgattgaacccttttgttcaggcgtgtatgctggcgatccttccaagttgagtatgaaagctgcttttggcaaagtttggatcttggaacaaaagggtggtagtatcattggtggtaccctcaaaacaatccaggaaagaaagaacaatccaaagccacctcgagacccgcgcctccctaaacctaagggccag

SEQ ID NO: 746 - DNA, 200 bp, Chenopodium album
gaacaaaagggttcaatcaagcgttcaaatacttcatcagcccagattacgacggacaaaatcttcaacagattcctcgtgagctggaggagaaggacgtaagccaagagcaccgagtccagacctaatcttgccagggaagctcataaggtcaaagaaagggaggtcagtgggcttggacggtacaggcctcaatttgc

SEQ ID NO: 747 - DNA, 200 bp, Chenopodium album
gcaaattgaggcctgtaccgtccaagcccactgacctccctttctttgaccttatgagcttccctggcaagattaggtctggactcggtgctcttggcttacgtccttctcctccagctcacgaggaatctgttgaagattttgtccgtcgtaatctgggctgatgaagtatttgaacgcttgattgaacccttttgttc

SEQ ID NO: 748 - DNA, 200 bp, Chenopodium album
ttggacggtacaggcctcaatttgccattccacaacacaaaacgaggggcgttaggatctccaaacaccaattcatctttcaatccactgtcaacagccatggtgagcactgcatcagatggctggaagctgttaggtccctcttcccagatatagccatcggcctccacagtagtgatgtttccaccaactcgatcttt

SEQ ID NO: 749 - DNA, 200 bp, Chenopodium album
aaagatcgagttggtggaaacatcactactgtggaggccgatggctatatctgggaagagggacctaacagcttccagccatctgatgcagtgctcaccatggctgttgacagtggattgaaagatgaattggtgtttggagatcctaacgcccctcgttttgtgttgtggaatggcaaattgaggcctgtaccgtccaa

SEQ ID NO: 750 - DNA, 200 bp, Chenopodium album
tgatgtttccaccaactcgatctttagcctccgtgacaatgaaatttggggagcgggaggagtattttgtagagagagcttgtgcaatgccaagaccactgattccaccacccacaatcacacagtcaagtacttcagcgccatcgattccaacagtagcagtgtttgtgttctggtaattgactgctgaatttgaggtc

SEQ ID NO: 751 - DNA, 200 bp, Chenopodium album
gacctcaaattcagcagtcaattaccagaacacaaacactgctactgttggaatcgatggcgctgaagtacttgactgtgtgattgtgggtggtggaatcagtggtcttggcattgcacaagctctctctacaaaatactcctcccgctccccaaatttcattgtcacggaggctaaagatcgagttggtggaaacatca

SEQ ID NO: 752 - DNA, 200 bp, Commelina diffusa
aattttcttgtgttatgggggaaaaaatctatattgtcataaagagaaaaaaaaattgaatatacaaaccacaacaattagattgctttttccctactatatggggttagctatatgaatcttagtttgcattttttcttatctaaaaaccatttctttagatggccctagataagacagtcaccttttaggacttcgtg

SEQ ID NO: 753 - DNA, 200 bp, Commelina diffusa
cacgaagtcctaaaaggtgactgtcttatctagggccatctaaagaaatggtttttagataagaaaaaatgcaaactaagattcatatagctaaccccatatagtagggaaaaagcaatctaattgttgtggtttgtatattcaatttttttttctctttatgacaatatagattttttcccccataacacaagaaaatt

SEQ ID NO: 754 - DNA, 200 bp, Commelina diffusa
gacagtcaccttttaggacttcgtgaagtgacttttttttttggttatataccatggttgcaagtctcagccaataccaatacgtatcatgtatcgagatcggtagctactgttataggatcgacatagtatcttggattgacatttgcttgttggctggctggccaattttggccagagaatggtaggagttggccggt

SEQ ID NO: 755 - DNA, 200 bp, Commelina diffusa
accggccaactcctaccattctctggccaaaattggccagccagccaacaagcaaatgtcaatccaagatactatgtcgatcctataacagtagctaccgatctcgatacatgatacgtattggtattggctgagacttgcaaccatggtatataaccaaaaaaaaaagtcacttcacgaagtcctaaaaggtgactgtc

SEQ ID NO: 756 - DNA, 200 bp, Commelina diffusa
cagagaatggtaggagttggccggtacgaccgtaacggtgtcaatttcacttggtatcagccaatatcgatcattatgagctctgacaccgttgatattgtattgaaaattaaaatttctattttagaaagttaaatttttattagtttatttatttcttgttaactaatattatcaatattgatacgtatcagatttga

SEQ ID NO: 757 - DNA, 200 bp, Commelina diffusa
tcaaatctgatacgtatcaatattgataatattagttaacaagaaataaataaactaataaaaatttaactttctaaaatagaaattttaattttcaatacaatatcaacggtgtcagagctcataatgatcgatattggctgataccaagtgaaattgacaccgttacggtcgtaccggccaactcctaccattctctg

SEQ ID NO: 758 - DNA, 200 bp, Commelina diffusa
caatattgatacgtatcagatttgaggaaacagatttgcagtcctggtctaaacctctaccctgtgtacgactaccgaaatctagtattgtaacttttctaacaggtgcatctactatctatagaacgtctacaaacacgtacaaactgctgtaaaggattttttcctaaacttgttattaatatgagtcacctatagtt

SEQ ID NO: 759 - DNA, 200 bp, Commelina diffusa
aactataggtgactcatattaataacaagtttaggaaaaaatcctttacagcagtttgtacgtgtttgtagacgttctatagatagtagatgcacctgttagaaaagttacaatactagatttcggtagtcgtacacagggtagaggtttagaccaggactgcaaatctgtttcctcaaatctgatacgtatcaatattg

SEQ ID NO: 760 - DNA, 200 bp, Commelina diffusa
ttattaatatgagtcacctatagttttccttgcacatacttgtttggagttgatctttcctagtgacacctaacttccacctcaacgttcttatctgtgctagacgcactgtttgggtatcttgcttcttaagagcccattattttcataaatcattgtagacctaataccaattttatacaatttacccttagatttaa

SEQ ID NO: 761 - DNA, 200 bp, Commelina diffusa
ttaaatctaagggtaaattgtataaaattggtattaggtctacaatgatttatgaaaataatgggctcttaagaagcaagatacccaaacagtgcgtctagcacagataagaacgttgaggtggaagttaggtgtcactaggaaagatcaactccaaacaagtatgtgcaaggaaaactataggtgactcatattaataa

SEQ ID NO: 762 - DNA, 200 bp, Commelina diffusa
ttatacaatttacccttagatttaagagactctacaatcacataacattcatgaagtttcttgccattttaaccatcttgttttaatgctattaataatatcttctatattttctctattatcttgaataatggacacaagatacataagttttttatttctaaccaactatactccatctaacataacaaattaatttg

SEQ ID NO: 763 - DNA, 200 bp, Commelina diffusa
caaattaatttgttatgttagatggagtatagttggttagaaataaaaaacttatgtatcttgtgtccattattcaagataatagagaaaatatagaagatattattaatagcattaaaacaagatggttaaaatggcaagaaacttcatgaatgttatgtgattgtagagtctcttaaatctaagggtaaattgtataa

SEQ ID NO: 764 - DNA, 200 bp, Commelina diffusa
ccatctaacataacaaattaatttgttcttgtcctactattaatatttcgtttcatatattttgttttaactctacttcatttaaaactaaaattacatgctggaactgaggttctaatcttaagttaacaccttctgctctctcatcatataaaacttctcaacaaaaaatttatgccaaggaatatcattctagatat

SEQ ID NO: 765 - DNA, 200 bp, Commelina diffusa
atatctagaatgatattccttggcataaattttttgttgagaagttttatatgatgagagagcagaaggtgttaacttaagattagaacctcagttccagcatgtaattttagttttaaatgaagtagagttaaaacaaaatatatgaaacgaaatattaatagtaggacaagaacaaattaatttgttatgttagatgg

SEQ ID NO: 766 - DNA, 200 bp, Commelina diffusa
tgccaaggaatatcattctagatatgccaaagtcaatagaagatatgaatttaaagaaccttggtggactcctattgtgataggagatctattgaactttcttacttatttttaattatgtcttatatctactagaaaccatttgcttttctaagatctaccaaagaacatccataggtattctatcatatgcattttct

SEQ ID NO: 767 - DNA, 200 bp, Commelina diffusa
agaaaatgcatatgatagaatacctatggatgttctttggtagatcttagaaaagcaaatggtttctagtagatataagacataattaaaaataagtaagaaagttcaatagatctcctatcacaataggagtccaccaaggttctttaaattcatatcttctattgactttggcatatctagaatgatattccttggca

SEQ ID NO: 768 - DNA, 200 bp, Commelina diffusa
aggtattctatcatatgcattttctgagtcaataagaaccatatacatgtctttgttcctatttctaagcgtttgtactaattgccttgataaactgatagtggtaggtataaatccaaaatgattattagaaatattagtttcacatcttagtcgttgttctgtcactattcttttcctactttcatcttcctaagagc

SEQ ID NO: 769 - DNA, 200 bp, Commelina diffusa
gctcttaggaagatgaaagtaggaaaagaatagtgacagaacaacgactaagatgtgaaactaatatttctaataatcattttggatttatacctaccactatcagtttatcaaggcaattagtacaaacgcttagaaataggaacaaagacatgtatatggttcttattgactcagaaaatgcatatgatagaatacct

SEQ ID NO: 770 - DNA, 200 bp, Commelina diffusa
ttcctactttcatcttcctaagagcatcttttacttcacaagtcctgatgttttgaatataagtagttctttttttttttaattagtggaatttacctgtaaaactatgtctagcaaggctctctccaagtgtaactttataatcctcataaatcctctgatcaccatttctagtgagaaaaggaaatcaatttggcccc

SEQ ID NO: 771 - DNA, 200 bp, Commelina diffusa
ggggccaaattgatttccttttctcactagaaatggtgatcagaggatttatgaggattataaagttacacttggagagagccttgctagacatagttttacaggtaaattccactaattaaaaaaaaaaagaactacttatattcaaaacatcaggacttgtgaagtaaaagatgctcttaggaagatgaaagtaggaa

SEQ ID NO: 772 - DNA, 200 bp, Commelina diffusa
gagaaaaggaaatcaatttggcccctactagaactatccttaaaagtaattaaatgacagtctctctttccatatagaataatgattaccaccgtattgtacgataaagcagattctaaaattttgacctttacattattcatctccccatacccataatcaccacaagtaaacttaattttcctactatcttttgccta

SEQ ID NO: 773 - DNA, 200 bp, Commelina diffusa
taggcaaaagatagtaggaaaattaagtttacttgtggtgattatgggtatggggagatgaataatgtaaaggtcaaaattttagaatctgctttatcgtacaatacggtggtaatcattattctatatggaaagagagactgtcatttaattacttttaaggatagttctagtaggggccaaattgatttccttttctc

SEQ ID NO: 774 - DNA, 200 bp, Commelina diffusa
taattttcctactatcttttgcctacgtgtcatggatgagtaccaggggaggaggagaggacaggggaaaaaggaacaaaatggaatcaaaataaaataaaatgctcatgccaacaataatgtggctaaaatcggacggaaaactaccgatggaagtttttgcagcatttaatgaaatgttaagtgtatttgctatttca

SEQ ID NO: 775 - DNA, 200 bp, Commelina diffusa
tgaaatagcaaatacacttaacatttcattaaatgctgcaaaaacttccatcggtagttttccgtccgattttagccacattattgttggcatgagcattttattttattttgattccattttgttcctttttcccctgtcctctcctcctcccctggtactcatccatgacacgtaggcaaaagatagtaggaaaatta

SEQ ID NO: 776 - DNA, 200 bp, Commelina diffusa
aatgttaagtgtatttgctatttcaaaaaaactcaattattttttattgttttggcaaaggtttagattttatctgcatttaactcttataaaacattatgaaatgatatttgttatcgactttcttgcactttcatgtgctaagcgtgtcacaactgctgaatgctactatgcaggaacaatatatagctcatcccttt

SEQ ID NO: 777 - DNA, 200 bp, Commelina diffusa
aaagggatgagctatatattgttcctgcatagtagcattcagcagttgtgacacgcttagcacatgaaagtgcaagaaagtcgataacaaatatcatttcataatgttttataagagttaaatgcagataaaatctaaacctttgccaaaacaataaaaaataattgagtttttttgaaatagcaaatacacttaacatt

SEQ ID NO: 778 - DNA, 200 bp, Commelina diffusa
ggaacaatatatagctcatccctttttcctggccgagctccccaagggagaatattgcttcttaactacattggaggtgctacaaatactggaattgtatcaaaggtgttggaacttgaccatttttcagtttttgtgaagttgcaaaaagttatatcctctacgaaaacatatgcagcttaggctatccataatatata

SEQ ID NO: 779 - DNA, 200 bp, Commelina diffusa
tatatattatggatagcctaagctgcatatgttttcgtagaggatataactttttgcaacttcacaaaaactgaaaaatggtcaagttccaacacctttgatacaattccagtatttgtagcacctccaatgtagttaagaagcaatattctcccttggggagctcggccaggaaaaagggatgagctatatattgttcc

SEQ ID NO: 780 - DNA, 200 bp, Commelina diffusa
cagcttaggctatccataatatataatccatttttaattagtgaaaacatatttcctaggaaacctcaattaaaatgtcatccattatgtctacaattgatactttattttgtttgctcttcttttccagacagtttttctagcatttacaccatgttgccactaggaatattgagtttggactggtttttccattcatt

SEQ ID NO: 781 - DNA, 200 bp, Commelina diffusa
aatgaatggaaaaaccagtccaaactcaatattcctagtggcaacatggtgtaaatgctagaaaaactgtctggaaaagaagagcaaacaaaataaagtatcaattgtagacataatggatgacattttaattgaggtttcctaggaaatatgttttcactaattaaaaatggattatatattatggatagcctaagctg

SEQ ID NO: 782 - DNA, 200 bp, Commelina diffusa
gtttggactggtttttccattcattggctaaaattttgtctatttcatttaaacatggagaggatgttgcaaacaccttctagatgtttgaattatcaaatcgttcataaagattttaagtcccaactaatatatgatgctgatttttcaagttttttttatgtgcagaatgagagcgaactggtagaagcagttgatcg

SEQ ID NO: 783 - DNA, 200 bp, Commelina diffusa
cgatcaactgcttctaccagttcgctctcattctgcacataaaaaaaacttgaaaaatcagcatcatatattagttgggacttaaaatctttatgaacgatttgataattcaaacatctagaaggtgtttgcaacatcctctccatgtttaaatgaaatagacaaaattttagccaatgaatggaaaaaccagtccaaac

SEQ ID NO: 784 - DNA, 200 bp, Commelina diffusa
gcgaactggtagaagcagttgatcgtgaccttagaaagatgctgataaagccaactgctgaggatcctcttcttgttggtgtaagagtatggccacaagctataccccagttcctggttggtcatcttgaccatctcgaggcagctaatgaagccctcaggaaaggaggttttggtggattttttcttggtggcaactat

SEQ ID NO: 785 - DNA, 200 bp, Commelina diffusa
atagttgccaccaagaaaaaatccaccaaaacctcctttcctgagggcttcattagctgcctcgagatggtcaagatgaccaaccaggaactggggtatagcttgtggccatactcttacaccaacaagaagaggatcctcagcagttggctttatcagcatctttctaaggtcacgatcaactgcttctaccagttcgc

SEQ ID NO: 786 - DNA, 200 bp, Commelina diffusa
ccatgctctaatagcttgtccgtcgtaatcttgggaatgaggtttttgaacgattgattgagccattctgttcaggtgcgcacaattcaattttcgctatgataagcaaaaaggtttttcacatgataattacctttgtttttttcttttggtgattaacatgcttttgtttgtaatgtcatatatatactatgttttac

SEQ ID NO: 787 - DNA, 200 bp, Commelina diffusa
gtaaaacatagtatatatatgacattacaaacaaaagcatgttaatcaccaaaagaaaaaaacaaaggtaattatcatgtgaaaaacctttttgcttatcatagcgaaaattgaattgtgcgcacctgaacagaatggctcaatcaatcgttcaaaaacctcattcccaagattacgacggacaagctattagagcatgg

SEQ ID NO: 788 - DNA, 200 bp, Commelina diffusa
atgtcatatatatactatgttttacctagatatttgttttgaatttttttttcttctggatttttagttttctgcgttctttactccaaattgaatcagtttgtcataactgttatggcaattgttttgatcatgtttttaaaggagtctccctgttttatcatctagcttaggagtaccaaaatgagcatttatgttct

SEQ ID NO: 789 - DNA, 200 bp, Commelina diffusa
agaacataaatgctcattttggtactcctaagctagatgataaaacagggagactcctttaaaaacatgatcaaaacaattgccataacagttatgacaaactgattcaatttggagtaaagaacgcagaaaactaaaaatccagaagaaaaaaaaattcaaaacaaatatctaggtaaaacatagtatatatatgacat

SEQ ID NO: 790 - DNA, 200 bp, Commelina diffusa
gtaccaaaatgagcatttatgttctctagaagttataggataagaaagacaggtgagaccttctggactgatttcacctaaaaaaatgctaaatctgcaggggtatatgctggagatcctacaaaacttagtatgaaggcagcttttggtaaagtatggaagttagaacagactggtggaagtattattgggggcactat

SEQ ID NO: 791 - DNA, 200 bp, Commelina diffusa
atagtgcccccaataatacttccaccagtctgttctaacttccatactttaccaaaagctgccttcatactaagttttgtaggatctccagcatatacccctgcagatttagcatttttttaggtgaaatcagtccagaaggtctcacctgtctttcttatcctataacttctagagaacataaatgctcattttggtac

SEQ ID NO: 792 - DNA, 200 bp, Commelina diffusa
gtggaagtattattgggggcactattaagacaatccaagatcaaaagaaaaatcccaaacctcctagagatccgtaagaatttcatgaaccaaattgggtttccatactacctgattgaaagtaatgaagtatccttgagttaattgttgctatttatcagacgcctaccaacaccaaaaggacaaacagttgcatcttt

SEQ ID NO: 793 - DNA, 200 bp, Commelina diffusa
aaagatgcaactgtttgtccttttggtgttggtaggcgtctgataaatagcaacaattaactcaaggatacttcattactttcaatcaggtagtatggaaacccaatttggttcatgaaattcttacggatctctaggaggtttgggatttttcttttgatcttggattgtcttaatagtgcccccaataatacttccac

SEQ ID NO: 794 - DNA, 200 bp, Commelina diffusa
caaaaggacaaacagttgcatcttttaggaaagggcttaacatgctacctgcagcaatttcttccaggtctttgttttttttcattctttgtaataccctgtaactatctgcaggcttttacaaactggttatactttttttttactttaccaagttggttagttagtagttatatttatgtgttcatactgaagatgag

SEQ ID NO: 795 - DNA, 200 bp, Commelina diffusa
ctcatcttcagtatgaacacataaatataactactaactaaccaacttggtaaagtaaaaaaaaagtataaccagtttgtaaaagcctgcagatagttacagggtattacaaagaatgaaaaaaaacaaagacctggaagaaattgctgcaggtagcatgttaagccctttcctaaaagatgcaactgtttgtccttttg

SEQ ID NO: 796 - DNA, 200 bp, Commelina diffusa
tttatgtgttcatactgaagatgagcaacttctgttttttatcataattatatttatatatttcttttgttatctatcaaggattatccttcagatctaacagttcacaaacttcactagcttgtatcttggaacatattttctttactttaatattttcattgacttgtatttcgtggaaaaacagactgggtagcaaa

SEQ ID NO: 797 - DNA, 200 bp, Commelina diffusa
tttgctacccagtctgtttttccacgaaatacaagtcaatgaaaatattaaagtaaagaaaatatgttccaagatacaagctagtgaagtttgtgaactgttagatctgaaggataatccttgatagataacaaaagaaatatataaatataattatgataaaaaacagaagttgctcatcttcagtatgaacacataaa

SEQ ID NO: 798 - DNA, 200 bp, Commelina diffusa
gtggaaaaacagactgggtagcaaagtgaaactatcatggaaacttgtgagcatcaggaagctggagagccaggaatatttattgctatatgaaacatcagaaggattgacttcagtacagactagaagtgttgttctgactgttccatcttatattgccagcaatctccttcgctctctttcagtaagcttatgcccca

SEQ ID NO: 799 - DNA, 200 bp, Commelina diffusa
tggggcataagcttactgaaagagagcgaaggagattgctggcaatataagatggaacagtcagaacaacacttctagtctgtactgaagtcaatccttctgatgtttcatatagcaataaatattcctggctctccagcttcctgatgctcacaagtttccatgatagtttcactttgctacccagtctgtttttccac

SEQ ID NO: 800 - DNA, 200 bp, Commelina diffusa
tctctttcagtaagcttatgccccactttaagcttctacagtccctttgaatatgtttatggaattctgttataaagaccttctcggttgctttttctgtagttaatttatgtggatggagaatctttctagaaattgttgacatgatactatatatggtatctatattgtgtgacatgttattgttgaccaatatatgc

SEQ ID NO: 801 - DNA, 200 bp, Commelina diffusa
gcatatattggtcaacaataacatgtcacacaatatagataccatatatagtatcatgtcaacaatttctagaaagattctccatccacataaattaactacagaaaaagcaaccgagaaggtctttataacagaattccataaacatattcaaagggactgtagaagcttaaagtggggcataagcttactgaaagaga

SEQ ID NO: 802 - DNA, 200 bp, Commelina diffusa
gctatatgaaacatcagaaggattgacttcagtacagactagaagtgttgttctgactgttccatcttatattgccagcaatctccttcgctctctttcaaatgacgcagctgatgctttgtcaaagttttactatcctccagttgctgctgtttccatttcatatccaaaggaagctattaggaacgaatgtttaatcg

SEQ ID NO: 803 - DNA, 200 bp, Commelina diffusa
cgattaaacattcgttcctaatagcttcctttggatatgaaatggaaacagcagcaactggaggatagtaaaactttgacaaagcatcagctgcgtcatttgaaagagagcgaaggagattgctggcaatataagatggaacagtcagaacaacacttctagtctgtactgaagtcaatccttctgatgtttcatatagc

SEQ ID NO: 804 - DNA, 200 bp, Commelina diffusa
gctattaggaacgaatgtttaatcgatggtgagcttaagggatttggccagttgcatccacgtagtcaaggagtagagacactcggaacaatatatagctcatcccttttcctggccgagctccccaagggagaatattgcttcttaactacattggaggtgctacaaatactggaattgtatcaaagaatgagagcgaa

SEQ ID NO: 805 - DNA, 200 bp, Commelina diffusa
ttcgctctcattctttgatacaattccagtatttgtagcacctccaatgtagttaagaagcaatattctcccttggggagctcggccaggaaaagggatgagctatatattgttccgagtgtctctactccttgactacgtggatgcaactggccaaatcccttaagctcaccatcgattaaacattcgttcctaatagc

SEQ ID NO: 806 - DNA, 200 bp, Commelina diffusa
ttatgattaaagatatatatatccaattagtttacttccacattgcataatgtaccttgatatatatttcctactagcattttttccttaaaattacgatttttgtatgattatcagattaacaacactagcggcctcttttatattgatcctagtggaaggaggatattcctcctaatttgttgtactaagacatcggc

SEQ ID NO: 807 - DNA, 200 bp, Commelina diffusa
gccgatgtcttagtacaacaaattaggaggaatatcctccttccactaggatcaatataaaagaggccgctagtgttgttaatctgataatcatacaaaaatcgtaattttaaggaaaaaatgctagtaggaaatatatatcaaggtacattatgcaatgtggaagtaaactaattggatatatatatctttaatcataa

SEQ ID NO: 808 - DNA, 200 bp, Commelina diffusa
taatttgttgtactaagacatcggctacatttttttttttgcttatggagacatctatattaatatttgtggttcacatgattcttgttgcttaaagattatttaatggatggtggttgcagaatgacgcagctgatgctttgtcaaagttttactatcctccagttgctgctgtttccatttcatatccaaaggaagct

SEQ ID NO: 809 - DNA, 200 bp, Commelina diffusa
agcttcctttggatatgaaatggaaacagcagcaactggaggatagtaaaactttgacaaagcatcagctgcgtcattctgcaaccaccatccattaaataatctttaagcaacaagaatcatgtgaaccacaaatattaatatagatgtctccataagcaaaaaaaaaaatgtagccgatgtcttagtacaacaaatta

SEQ ID NO: 810 - DNA, 200 bp, Commelina diffusa
ttccatttcatatccaaaggaagctattaggaacgaatgtttaatcgatggtgagcttaagggatttggccagttgcatccacgtagtcaaggagtagagacactcggtactgttctgtcttgtttatggccccacactactcaccccaaatataatataggttctatatgtatatgctctctggatttccatttgcaat

SEQ ID NO: 811 - DNA, 200 bp, Commelina diffusa
attgcaaatggaaatccagagagcatatacatatagaacctatattatatttggggtgagtagtgtggggccataaacaagacagaacagtaccgagtgtctctactccttgactacgtggatgcaactggccaaatcccttaagctcaccatcgattaaacattcgttcctaatagcttcctttggatatgaaatggaa

SEQ ID NO: 812 - DNA, 200 bp, Conyza canadensis
aaaagtatatttaaaattttttgcccacaccaaaaaaaattttaaaaaaaagaagtacatatgcaatcaatgacatgcgatttcaatcccaactttcaaatctcaatttttaaatgctagtagctataagtaaataatctccattctccttctctatacatcttttcttattcaacaggtaatactttcatttattaatc

SEQ ID NO: 813 - DNA, 200 bp, Conyza canadensis
gattaataaatgaaagtattacctgttgaataagaaaagatgtatagagaaggagaatggagattatttacttatagctactagcatttaaaaattgagatttgaaagttgggattgaaatcgcatgtcattgattgcatatgtacttcttttttttaaaattttttttggtgtgggcaaaaaattttaaatatactttt

SEQ ID NO: 814 - DNA, 200 bp, Conyza canadensis
caggtaatactttcatttattaatcataaaattatacatatatattttccctaatttttaggtttcttaatttcttttgacgtgaattgaaagatgaaaacgtgatgatagattggaagagttgaagaggggttttgttttggggaatctcatacataacacactaaacaacatattatcagttatcttgtattgattta

SEQ ID NO: 815 - DNA, 200 bp, Conyza canadensis
taaatcaatacaagataactgataatatgttgtttagtgtgttatgtatgagattccccaaaacaaaacccctcttcaactcttccaatctatcatcacgttttcatctttcaattcacgtcaaaagaaattaagaaacctaaaaattagggaaaatatatatgtataattttatgattaataaatgaaagtattacctg

SEQ ID NO: 816 - DNA, 200 bp, Conyza canadensis
ttatcagttatcttgtattgatttaatataaaatatgagtactaaaataccattatatggatcgtataagtttagtgaatagttcgtgcttttggttatacgacgaaattgtagttggtttattatatcgtcttttgagtttgcattttggttgtaattggatggttattattttgtgggtatatgaatttattggaatt

SEQ ID NO: 817 - DNA, 200 bp, Conyza canadensis
aattccaataaattcatatacccacaaaataataaccatccaattacaaccaaaatgcaaactcaaaagacgatataataaaccaactacaatttcgtcgtataaccaaaagcacgaactattcactaaacttatacgatccatataatggtattttagtactcatattttatattaaatcaatacaagataactgataa

SEQ ID NO: 818 - DNA, 200 bp, Conyza canadensis
gtgggtatatgaatttattggaatttgatcgatatattaaaatttttgtacctatataatgttttaaatttgtcaccttacgataaagttcctggctccgccttgatagcagccttcatgtaaaattggttttcataaacgttctgagtttttataaattttgtaacatgtcattcttctggaaatatgcttctcttcaa

SEQ ID NO: 819 - DNA, 200 bp, Conyza canadensis
ttgaagagaagcatatttccagaagaatgacatgttacaaaatttataaaaactcagaacgtttatgaaaaccaattttacatgaaggctgctatcaaggcggagccaggaactttatcgtaaggtgacaaatttaaaacattatataggtacaaaaattttaatatatcgatcaaattccaataaattcatatacccac

SEQ ID NO: 820 - DNA, 200 bp, Conyza canadensis
cttctggaaatatgcttctcttcaatttaacgcgtatatgagcgttgcattcgcatataatcgaatgtctcgtggaaagtactaaagacttggccaacgttaggtttcattatcatcttctaggggattgtttaagtccaacataattaagaatttacaaacagaaggaacaacgtaggaaaagtcataatcaattgaat

SEQ ID NO: 821 - DNA, 200 bp, Conyza canadensis
attcaattgattatgacttttcctacgttgttccttctgtttgtaaattcttaattatgttggacttaaacaatcccctagaagatgataatgaaacctaacgttggccaagtctttagtactttccacgagacattcgattatatgcgaatgcaacgctcatatacgcgttaaattgaagagaagcatatttccagaag

SEQ ID NO: 822 - DNA, 200 bp, Conyza canadensis
taggaaaagtcataatcaattgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggtatgaagttgaaata

SEQ ID NO: 823 - DNA, 200 bp, Conyza canadensis
tatttcaacttcataccatcattgctgaaaatgaaggtctgtaatttttgcagtaatctttaacattgttattatttaaggaagatccatatatgtttgtatgttatagtagttgtttttcaacctcatcttactatatcttagtttaagtactgataaattgactaatcaaactattcaattgattatgacttttccta

SEQ ID NO: 824 - DNA, 200 bp, Conyza canadensis
gcaatgatggtatgaagttgaaataatcgtttgttgttttcaattaacattttttcacaaagggagagagataaatatggtgatcagctttatatttcaatataatgtgaaaggtctgaaaaaaaaatttgaccaagtgtaaaaaatatgttttggataaataaaagttaatttaaataatctactaaaattagcccctg

SEQ ID NO: 825 - DNA, 200 bp, Conyza canadensis
caggggctaattttagtagattatttaaattaacttttatttatccaaaacatattttttacacttggtcaaatttttttttcagacctttcacattatattgaaatataaagctgatcaccatatttatctctctccctttgtgaaaaaatgttaattgaaaacaacaaacgattatttcaacttcataccatcattgc

SEQ ID NO: 826 - DNA, 200 bp, Conyza canadensis
aataatctactaaaattagcccctggtttacaaatatcatttcacttataatttattaaccataatttactaatttgttcagtcaaacttttttttttatatagtttctttatttaacgtactcacaacacattacaatctctcatattgggtatttttactgctgcattacgtgagtttttttttattgtatcatataa

SEQ ID NO: 827 - DNA, 200 bp, Conyza canadensis
ttatatgatacaataaaaaaaaactcacgtaatgcagcagtaaaaatacccaatatgagagattgtaatgtgttgtgagtacgttaaataaagaaactatataaaaaaaaaagtttgactgaacaaattagtaaattatggttaataaattataagtgaaatgatatttgtaaaccaggggctaattttagtagattatt

SEQ ID NO: 828 - DNA, 200 bp, Conyza canadensis
agtttttttttattgtatcatataatttttgacaaatgatttttaataaaacaaaccttttcactctttaatggtgaggtttcaattccacagtttaatcaattgccgatcgatgtatatatgtaatttttagttttaatttagtaaatacaaaattatttaactagggtataggaagagtagacttgaaaatatgggtg

SEQ ID NO: 829 - DNA, 200 bp, Conyza canadensis
cacccatattttcaagtctactcttcctataccctagttaaataattttgtatttactaaattaaaactaaaaattacatatatacatcgatcggcaattgattaaactgtggaattgaaacctcaccattaaagagtgaaaaggtttgttttattaaaaatcatttgtcaaaaattatatgatacaataaaaaaaaact

SEQ ID NO: 830 - DNA, 200 bp, Conyza canadensis
aagagtagacttgaaaatatgggtgataatttcttgattctttcaatttgagtaagttaaagaaatcttaactcttcaaattttggcctttaatttatatctaaaggttaatttttatctaaaggttaacattactataacttggactaattccctccctaaaaatatatacccattttccttatctgacttggaaaata

SEQ ID NO: 831 - DNA, 200 bp, Conyza canadensis
tattttccaagtcagataaggaaaatgggtatatatttttagggagggaattagtccaagttatagtaatgttaacctttagataaaaattaacctttagatataaattaaaggccaaaatttgaagagttaagatttctttaacttactcaaattgaaagaatcaagaaattatcacccatattttcaagtctactctt

SEQ ID NO: 832 - DNA, 200 bp, Conyza canadensis
ttttccttatctgacttggaaaatagtggggtagatcggatctgacctaacctgatttgacccgatccgacccgaacgttgaaaatgaaaattagtttactagaggtggttcacccacagagaaattataccaaaccgaaacaacccaacaatggcttctccaacaacaacaacagatgataacaaaggtagatactatt

SEQ ID NO: 833 - DNA, 200 bp, Conyza canadensis
aatagtatctacctttgttatcatctgttgttgttgttggagaagccattgttgggttgtttcggtttggtataatttctctgtgggtgaaccacctctagtaaactaattttcattttcaacgttcgggtcggatcgggtcaaatcaggttaggtcagatccgatctaccccactattttccaagtcagataaggaaaa

SEQ ID NO: 834 - DNA, 200 bp, Conyza canadensis
gatgataacaaaggtagatactatttctttttcttcttaataatcttaatatgttattattttcattgtagataatccagttctgcattttgttgcacagagaaagcacctgctaagagagttgcagttgttggcgccggtgtcaggtcaatgttactactttcatatatataatatatgtatcttgcgttttattttac

SEQ ID NO: 835 - DNA, 200 bp, Conyza canadensis
gtaaaataaaacgcaagatacatatattatatatatgaaagtagtaacattgacctgacaccggcgccaacaactgcaactctcttagcaggtgctttctctgtgcaacaaaatgcagaactggattatctacaatgaaaataataacatattaagattattaagaagaaaaagaaatagtatctacctttgttatcatc

SEQ ID NO: 836 - DNA, 200 bp, Conyza canadensis
atatgtatcttgcgttttattttacttcttactttttacggcgaaatacccaaatatcccaccccacggaaggttatgtagactttggttttctttgacctctatagttggttacttgttatggccatgaaatgaaagattcctaaacgagggtggagattactctagcgtttgttttgaccccaaaaatgctttgcttg

SEQ ID NO: 837 - DNA, 200 bp, Conyza canadensis
caagcaaagcatttttggggtcaaaacaaacgctagagtaatctccaccctcgtttaggaatctttcatttcatggccataacaagtaaccaactatagaggtcaaagaaaaccaaagtctacataaccttccgtggggtgggatatttgggtatttcgccgtaaaaagtaagaagtaaaataaaacgcaagatacatat

SEQ ID NO: 838 - DNA, 200 bp, Conyza canadensis
tttgaccccaaaaatgctttgcttgtcggaggacatgaccaatatttagaggactaggattagcttagcggaatatggtagataagtaatccttttaggggtactttatataattgtggattttcatgcatgatacctttcttatatgctcatatgacttctttgcactgttaggggtagtgttcttgacagctaggtga

SEQ ID NO: 839 - DNA, 200 bp, Conyza canadensis
tcacctagctgtcaagaacactacccctaacagtgcaaagaagtcatatgagcatataagaaaggtatcatgcatgaaaatccacaattatataaagtacccctaaaaggattacttatctaccatattccgctaagctaatcctagtcctctaaatattggtcatgtcctccgacaagcaaagcatttttggggtcaaa

SEQ ID NO: 840 - DNA, 200 bp, Conyza canadensis
ggtagtgttcttgacagctaggtgacctatgctactttgtttcataggtcgattagggattagcacccactatttttttatttttttggaaggcattaaattatattatattaaagataaaaattgccagtaagaaactagccgatacatagactgtccaatccaaaatagaaaactagcacccacattatatgtgggcc

SEQ ID NO: 841 - DNA, 200 bp, Conyza canadensis
ggcccacatataatgtgggtgctagttttctattttggattggacagtctatgtatcggctagtttcttactggcaatttttatctttaatataatataatttaatgccttccaaaaaaataaaaaaatagtgggtgctaatccctaatcgacctatgaaacaaagtagcataggtcacctagctgtcaagaacactacc

SEQ ID NO: 842 - DNA, 200 bp, Conyza canadensis
ctagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggaga

SEQ ID NO: 843 - DNA, 200 bp, Conyza canadensis
tctcctcccagcaagtcatagaagcaaataggtttggtagtacgagtggcatgtgcaagaagtcaagaacccctttaacctcctcccagcaagtcacaaaagcaaatagggttggtatcagccatgcatacatagatataagtagatatttactaggaagtcctagggaccggtgggcccacatataatgtgggtgctag

SEQ ID NO: 844 - DNA, 200 bp, Conyza canadensis
gcttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagta

SEQ ID NO: 845 - DNA, 200 bp, Conyza canadensis
tactcttactacattaagagtagacaagggtagaagacataccacatagcccaaattggacaatacatagtaaataagacatttgaacatattaaacatcataaaaacataataaatataaccgtctgcatagaaccaaacatgtgggatgagagcaacaattaataggggcatgtctcctcccagcaagtcatagaagc

SEQ ID NO: 846 - DNA, 200 bp, Conyza canadensis
gtctactcttaatgtagtaagagtatcatcatactcgatcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttg

SEQ ID NO: 847 - DNA, 200 bp, Conyza canadensis
caaaaacaacatgacccaattcttgtgcgaggggtatgggggatgtgagatgtagacagtcttgcctctacccagaggcagaaagactacttccataaggacctccatccaaaaaaggcaaaagtaggagagtgtaaagagttcagtaaccatacctgtcgatcgagtatgatgatactcttactacattaagagtagac

SEQ ID NO: 848 - DNA, 200 bp, Conyza canadensis
caagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatgg

SEQ ID NO: 849 - DNA, 200 bp, Conyza canadensis
ccattcctctagatatcaatcaatcaccatgttgcactagactactatactcaccaatttatttacaaatttcatacatgtaacgaataatcaaaataatatattatactagcagcaaaaaatcaacaatatgtaaaccccattggaaacatcttaccatctgggttcgagtccacaaaaacaacatgacccaattcttg

SEQ ID NO: 850 - DNA, 200 bp, Conyza canadensis
gattgattgatatctagaggaatggctggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgcc

SEQ ID NO: 851 - DNA, 200 bp, Conyza canadensis
ggcaccctcgtcccatattaaaccgttttgtgaaatgcttcttagtttccctccggctatctcaccggcttcaaaaacagtgacatttattccatgtagttttaacttatatgcagccgcaagcccactgaaacaaaccaagtcattcattcatgattcaacataatatggccagccattcctctagatatcaatcaatc

SEQ ID NO: 852 - DNA, 200 bp, Conyza canadensis
cggtttaatatgggacgagggtgccaatactatggtatgatatcgatgttagtttgcttatagacataacttctttttttttattttttttaaaaaaaagttgttttgatgctcttttactccgtatttgtagactgagagtgaaccggatgtcagcaggttgcttgatgatcttggtcttcgagataaacaacagtctg

SEQ ID NO: 853 - DNA, 200 bp, Conyza canadensis
cagactgttgtttatctcgaagaccaagatcatcaagcaacctgctgacatccggttcactctcagtctacaaatacggagtaaaagagcatcaaaacaacttttttttaaaaaaaataaaaaaaaagaagttatgtctataagcaaactaacatcgatatcataccatagtattggcaccctcgtcccatattaaaccg

SEQ ID NO: 854 - DNA, 200 bp, Conyza canadensis
ggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccactttatgtggc

SEQ ID NO: 855 - DNA, 200 bp, Conyza canadensis
gccacataaagtggatttagccttccgtatttgaacacgaataaaagtgatataaacaatttcctcttctttatactatgtcatttagtatacaatgggagaaatttgcaaaaataaattttcaaacgcacgctacaggaagcatgatgttccatatccaacagcatataacttacagactgttgtttatctcgaagacc

SEQ ID NO: 856 - DNA, 200 bp, Conyza canadensis
gaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgatatctcaaca

SEQ ID NO: 857 - DNA, 200 bp, Conyza canadensis
tgttgagatatcataccagtaccggttttccatttcttacaatatatcgcttatgttgggaaagtggctgcaaaaggaaatatagtgtagtattcagccatggtaaacatatacacacatgaccacaacaaataaatgaaacaagaaccatagccgacaaattattacagccacagccacataaagtggatttagccttc

SEQ ID NO: 858 - DNA, 200 bp, Conyza canadensis
ccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttttgttttctgg

SEQ ID NO: 859 - DNA, 200 bp, Conyza canadensis
ccagaaaacaaaaaatcagtttacaaaactttgtaaacaaatgacaagtgtttatgaggttgagaatttgagtccaataaaacacaatttctactaatgattttgaagtaaagtttcatcttatacttttaaactcttttgttcatatataacagaggattagttttcagcatggtgttgagatatcataccagtaccgg

SEQ ID NO: 860 - DNA, 200 bp, Conyza canadensis
tgtaaactgattttttgttttctgggaatgtaaataattatggcagtttattgtactgttctttcgtatagatagttataaactcaaaacacaaaaaaaaggttgttttattacgcggtcgtagctgtcacaattttagttttcttttgtacttgccaagttcatgtcttatatactgaatgtaacttggccaaactcat

SEQ ID NO: 861 - DNA, 200 bp, Conyza canadensis
atgagtttggccaagttacattcagtatataagacatgaacttggcaagtacaaaagaaaactaaaattgtgacagctacgaccgcgtaataaaacaaccttttttttgtgttttgagtttataactatctatacgaaagaacagtacaataaactgccataattatttacattcccagaaaacaaaaaatcagtttaca

SEQ ID NO: 862 - DNA, 200 bp, Conyza canadensis
ctgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggctcacaaaaac

SEQ ID NO: 863 - DNA, 200 bp, Conyza canadensis
gtttttgtgagccttgacattgagaatcattgggtagataatatgagaatgaaaggattggatacggtttaaatacttcagacttaaacatccaagagctactaacgaacctttgattgagtggaaagcaaactgctttggatcagtgcaatggggttagaaggtacctgcagacatgagtttggccaagttacattcag

SEQ ID NO: 864 - DNA, 200 bp, Conyza canadensis
tctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttcattacattg

SEQ ID NO: 865 - DNA, 200 bp, Conyza canadensis
caatgtaatgaagtacaaattataattttgagatcatctgatatcaaaatgagaaagaatttgtgtaactcgtgtgctaatatattaccattgcaattttggataattttttaaatacaaccgaaaagggcatgcatcatttttattaaaaatttaaagcatagtaggataaagagtttttgtgagccttgacattgaga

SEQ ID NO: 866 - DNA, 200 bp, Conyza canadensis
ttataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaacttttttatttatttactattttgt

SEQ ID NO: 867 - DNA, 200 bp, Conyza canadensis
acaaaatagtaaataaataaaaaagttagtccctaatagggtttaacagatagataggaaagaaggctatatattacctttcttgtgtatcagacgagttcttcttcttccatgaaaatggctccaaaagtatttgaagctgtaatttttgcaacaaaccccataatcacatacacaatgtaatgaagtacaaattataa

SEQ ID NO: 868 - DNA, 200 bp, Conyza canadensis
cttttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatcttaattttcta

SEQ ID NO: 869 - DNA, 200 bp, Conyza canadensis
tagaaaattaagatagcggaaagcatggacaaattttgaagtaccacacaaatgaaaacttggaccccttaatatcaaaagaaagacgtataccagaataactgaactgaagataaaggttacaatatacatatacctccttcccaaaatgacgttgaaagaatgcaccaacactacaaaatagtaaataaataaaaaag

SEQ ID NO: 870 - DNA, 200 bp, Conyza canadensis
tgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaacactttaaa

SEQ ID NO: 871 - DNA, 200 bp, Conyza canadensis
tttaaagtgtttttgtttgttaattgaaatcagttatgtatatccccacactaatatgaagcagcatggacatggaagagttactcacagaaagtgactccggatctccaccgcttgttccagcaacaacaggattaatgagatactcaacaaccttacatatgtacattaagtatagaaaattaagatagcggaaagca

SEQ ID NO: 872 - DNA, 200 bp, Conyza canadensis
aattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgtaattcatt

SEQ ID NO: 873 - DNA, 200 bp, Conyza canadensis
aatgaattacatattattttgtagcttacataccttctctctaaatcccataattcagggaatgaatagcgcatctgtatggaaaatatgaggttgatagattaacctagaaggttaatgatgagaggtagcacttagcaggggtgtcaaagaatgcatttgcacctccacatgctttaaagtgtttttgtttgttaatt

SEQ ID NO: 874 - DNA, 200 bp, Conyza canadensis
gctacaaaataatatgtaattcattctttaagtgagcttgattatttgttcccatgcaatctactatgattttttattataatatttataaagcttggattcttaaattcaatgtgatgacggtcaaatcaacatgcaggtttggttcactcatttctggggcatttcagtctatgatctcttctcgaggcagaaaaaag

SEQ ID NO: 875 - DNA, 200 bp, Conyza canadensis
cttttttctgcctcgagaagagatcatagactgaaatgccccagaaatgagtgaaccaaacctgcatgttgatttgaccgtcatcacattgaatttaagaatccaagctttataaatattataataaaaaatcatagtagattgcatgggaacaaataatcaagctcacttaaagaatgaattacatattattttgtagc

SEQ ID NO: 876 - DNA, 200 bp, Conyza canadensis
gatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatctttattctc

SEQ ID NO: 877 - DNA, 200 bp, Conyza canadensis
gagaataaagatttaaaagaacaaagtaagcaatatattgatggcctgtttctactttaaagaatatattagattccaataaatgaatcttgacagacaaaatcaccaatcttacctgcattccacctaaaaatgaaaaggagccacgcctgcgcttgctgcttcctgaaggactcttttttctgcctcgagaagagatc

SEQ ID NO: 878 - DNA, 200 bp, Conyza canadensis
tttgttcttttaaatctttattctcatgcagacacttacaaatgcactgagcaaagaagttggacaacatgaacttaatcttcaatccaaggtgcttgaaatgtcctatagctgtgatgataacactactgggagttggtcgatctattgtgctccagatcagaacaaacaattaaatcagcaaccttttgatgctgtga

SEQ ID NO: 879 - DNA, 200 bp, Conyza canadensis
tcacagcatcaaaaggttgctgatttaattgtttgttctgatctggagcacaatagatcgaccaactcccagtagtgttatcatcacagctataggacatttcaagcaccttggattgaagattaagttcatgttgtccaacttctttgctcagtgcatttgtaagtgtctgcatgagaataaagatttaaaagaacaaa

SEQ ID NO: 880 - DNA, 200 bp, Conyza canadensis
aatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattcttattctc

SEQ ID NO: 881 - DNA, 200 bp, Conyza canadensis
gagaataagaatttccatattttgtccacagatttgaatatttgatgaatccagatccaccaagatagcacaaaaaaaagttgctgagacaaactagtcttgtcaaaatgcaaaacattaaccaaatttatgtcaatgtcaccgtaagataacacaactatactcacagtcatgatcacagcatcaaaaggttgctgatt

SEQ ID NO: 882 - DNA, 200 bp, Conyza canadensis
acaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtccgttcctgctcaatttta

SEQ ID NO: 883 - DNA, 200 bp, Conyza canadensis
taaaattgagcaggaacggacttcctgtctttgtaatcttcatttctttcacattgccaagtggggcctaattcgggagcatgtactgtgttaattacgttctaattgcacttacaaactaataagcattaaaacaaatgggtgtataaacaataattctcctatttctgaaatagagaataagaatttccatattttgt

SEQ ID NO: 884 - DNA, 200 bp, Conyza canadensis
ggaagtccgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtttcagtcat

SEQ ID NO: 885 - DNA, 200 bp, Conyza canadensis
atgactgaaactggcatataactaagctgcattataaaaaccagaaaatattcctttaaaggatatctccccatggtaaagattattgtttaaatttcaaaagagctaaaactaaggggttctgcacgaattccatatgatagaactcacacggtacaataacatacctcaggtataaaattgagcaggaacggacttcc

SEQ ID NO: 886 - DNA, 200 bp, Conyza canadensis
ttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcttttttttttctttattgtcta

SEQ ID NO: 887 - DNA, 200 bp, Conyza canadensis
tagacaataaagaaaaaaaaaagaaaaaaaaatgaaaaggaaaaaaaaaaaaaagataatacacaggcaagctttacctaacgtcttcaaaccattttcctgctccttggcaggaacaagcattccaaatccctcaaggggccgcttcacattctctttcttgaatgtagagattatgactgaaactggcatataactaa

SEQ ID NO: 888 - DNA, 200 bp, Conyza canadensis
ttcttttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgctcaatatt

SEQ ID NO: 889 - DNA, 200 bp, Conyza canadensis
aatattgagcagaaattattgcaatgatcaagcctacctcgaagcattggccagttctttgtttcgacttcccccaacaaaggtggtataaagatacaagtcttcaggggcacgatctggaaacatcatggaagaaaagagagtgcctgcataacagaattttcaataataattatagacaataaagaaaaaaaaaagaa

SEQ ID NO: 890 - DNA, 200 bp, Conyza canadensis
attgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaaaggagaaa

SEQ ID NO: 891 - DNA, 200 bp, Conyza canadensis
tttctcctttcctccaaaaaagtttccaaactaaattattacttactcatcataatcatcataaataatagattgatattcctatagggaatggtcaagaagattctcttatgaagtttttagagacagccattatacaactacttcctcaatacttgagtaaatttgaagctaaaatattgagcagaaattattgcaat

SEQ ID NO: 892 - DNA, 200 bp, Conyza canadensis
aaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaaggacacatt

SEQ ID NO: 893 - DNA, 200 bp, Conyza canadensis
aatgtgtccttacgtcaaaaattgtggctctccctctgctccaagcaactgtctgaggtcagaagttactatctgcttcaactcatccctgtatttacagaaaatatatattattgcaagaattatacttgagttatgtcctctccccttaaacagcaacaagaaagctccaacatttctcctttcctccaaaaaagttt

SEQ ID NO: 894 - DNA, 200 bp, Conyza canadensis
acaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttttaaaagcc

SEQ ID NO: 895 - DNA, 200 bp, Conyza canadensis
ggcttttaaaaaaaagttaaatttcaagaaacaatttcaattggtgaacatgcgccaatgaaaaagtctaagctgaaaattaagttgtgtaattgtttgtatagtgctcaggaatgcaattcttgcaatcctttgatctagataaactaacgtttaataaaagcagcagagctagaatgtgtccttacgtcaaaaattgt

SEQ ID NO: 896 - DNA, 200 bp, Conyza canadensis
gaaatttaacttttttttaaaagcccgaggttcacagatacttttacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagcaattgagaa

SEQ ID NO: 897 - DNA, 200 bp, Conyza canadensis
ttctcaattgcttccataactaagccatagtcacgcccgtacaatggatatgctttgctccagtaatagtgactgcaattaaactacatcattatcatgtatgacatgaacaaaaaaacacaagacaaattaagcataagctacttgtacattgtaaaagtatctgtgaacctcgggcttttaaaaaaaagttaaatttc

SEQ ID NO: 898 - DNA, 200 bp, Conyza canadensis
gcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttatatatcatc

SEQ ID NO: 899 - DNA, 200 bp, Conyza canadensis
gatgatatataaaggttttatgtataagtaggggtattttaggaagaaaaaaaatgcttaattttaagaaatctaatactctttataagggagtatagatatgtatatatctactttatttcaaacacaaaaaggtttacccgcataaaagtaaccaggtagctctctttccatcttctcaattgcttccataactaagc

SEQ ID NO: 900 - DNA, 200 bp, Conyza canadensis
atacataaaacctttatatatcatcctttcccacattgtctctaatcattacacgctctcatcgaccttttatcacccttcgccaccgccctcctccaccgcctctctcgatctccaccaccgtcttccatcaccttttagccgctacaacgcgcgggcattatgctcgttttaaaaaagcaagttaaaaaggatagtag

SEQ ID NO: 901 - DNA, 200 bp, Conyza canadensis
ctactatcctttttaacttgcttttttaaaacgagcataatgcccgcgcgttgtagcggctaaaaggtgatggaagacggtggtggagatcgagagaggcggtggaggagggcggtggcgaagggtgataaaaggtcgatgagagcgtgtaatgattagagacaatgtgggaaaggatgatatataaaggttttatgtat

SEQ ID NO: 902 - DNA, 200 bp, Conyza canadensis
aaaagcaagttaaaaaggatagtaggttgataagaatgactaaatgaggacaaatctattaggtaaccacaaaggaggacttgcagttggaaaagcaatatcctctggatgcgaagcagccgaatctgtgatttcatatttggattcatattccgatgagaagcgttgctagatgttgtggtaatactatttatgataca

SEQ ID NO: 903 - DNA, 200 bp, Conyza canadensis
tgtatcataaatagtattaccacaacatctagcaacgcttctcatcggaatatgaatccaaatatgaaatcacagattcggctgcttcgcatccagaggatattgcttttccaactgcaagtcctcctttgtggttacctaatagatttgtcctcatttagtcattcttatcaacctactatcctttttaacttgctttt

SEQ ID NO: 904 - DNA, 200 bp, Conyza canadensis
ttgtggtaatactatttatgatacaaaaatgaatgaaattctgagcctgaaccatataatcctgcattttcttaattattattcaaagtgcaagacttttcaggtacgtgtacatctcaagaagttttctttccatcgggattggataaatatggcgaaaaaatagtgtggctttttccggtgtctttgaatgtagtcga

SEQ ID NO: 905 - DNA, 200 bp, Conyza canadensis
tcgactacattcaaagacaccggaaaaagccacactattttttcgccatatttatccaatcccgatggaaagaaaacttcttgagatgtacacgtacctgaaaagtcttgcactttgaataataattaagaaaatgcaggattatatggttcaggctcagaatttcattcatttttgtatcataaatagtattaccacaa

SEQ ID NO: 906 - DNA, 200 bp, Conyza canadensis
ttccggtgtctttgaatgtagtcgaaggactaagctttagttacttttataatgcaataataatggatcaaagtgttgtagaaattgatcgttccggatgatgttaaacattgcaaaatgttgtaacaaaacatggggctcgggttttgcttaatttgcatctgtaacaaaggctcgccatttttgggtatacttttaac

SEQ ID NO: 907 - DNA, 200 bp, Conyza canadensis
gttaaaagtatacccaaaaatggcgagcctttgttacagatgcaaattaagcaaaacccgagccccatgttttgttacaacattttgcaatgtttaacatcatccggaacgatcaatttctacaacactttgatccattattattgcattataaaagtaactaaagcttagtccttcgactacattcaaagacaccggaa

SEQ ID NO: 908 - DNA, 200 bp, Conyza canadensis
cgccatttttgggtatacttttaactatctgtctcaaccaaatagtttaaataaacgtgcttgaattagttgtacttttattataaatagttaggggatgaacttttgatatagaatatacaaattttctattcaagttaattatagccgttagaaaaatccctaaataaaagccaatcaggttttaggttttttttttt

SEQ ID NO: 909 - DNA, 200 bp, Conyza canadensis
aaaaaaaaaaacctaaaacctgattggcttttatttagggatttttctaacggctataattaacttgaatagaaaatttgtatattctatatcaaaagttcatcccctaactatttataataaaagtacaactaattcaagcacgtttatttaaactatttggttgagacagatagttaaaagtatacccaaaaatggcg

SEQ ID NO: 910 - DNA, 200 bp, Conyza canadensis
aatcaggttttaggttttttttttttcttgaaaagttttccattattttaagggttattccttgatggtgagccatttttgctcgttatagcggtctaaatagattttacctgtgaccggtgttatccattcacatggtcacctccaaaatatgcttaaggacatattcgaacttgaaatcttttgtgaggaaacatata

SEQ ID NO: 911 - DNA, 200 bp, Conyza canadensis
tatatgtttcctcacaaaagatttcaagttcgaatatgtccttaagcatattttggaggtgaccatgtgaatggataacaccggtcacaggtaaaatctatttagaccgctataacgagcaaaaatggctcaccatcaaggaataacccttaaaataatggaaaacttttcaagaaaaaaaaaaaacctaaaacctgatt

SEQ ID NO: 912 - DNA, 200 bp, Conyza canadensis
gaaatcttttgtgaggaaacatataattctttcgggttttgctaaacaaagctcaatgggtgtgcattaaatagttgtacacttaccataaaaatcaggggtgagcttttgatatgaaaaagtacaacttttttatgtactataagtgaaaccctaagggctttatttaacattttccaattctttatcactagataaac

SEQ ID NO: 913 - DNA, 200 bp, Conyza canadensis
gtttatctagtgataaagaattggaaaatgttaaataaagcccttagggtttcacttatagtacataaaaaagttgtactttttcatatcaaaagctcacccctgatttttatggtaagtgtacaactatttaatgcacacccattgagctttgtttagcaaaacccgaaagaattatatgtttcctcacaaaagatttc

SEQ ID NO: 914 - DNA, 200 bp, Conyza canadensis
tccaattctttatcactagataaacttgatgatggttagcttctttttttttcctaaacataggtgtcttactcacttagactagacccaaaagttgactcgctttgcgagcccaagtcagagtaggtaagtctctctttgggtcactagagtatttttcttaaggagtttcatccttttagagacatccccaatcaatg

SEQ ID NO: 915 - DNA, 200 bp, Conyza canadensis
cattgattggggatgtctctaaaaggatgaaactccttaagaaaaatactctagtgacccaaagagagacttacctactctgacttgggctcgcaaagcgagtcaacttttgggtctagtctaagtgagtaagacacctatgtttaggaaaaaaaaagaagctaaccatcatcaagtttatctagtgataaagaattgga

SEQ ID NO: 916 - DNA, 200 bp, Conyza canadensis
cttttagagacatccccaatcaatggacctccaccctagtgttttggttggttaataatttagtattattatccctgttatatattcttacaagaggttttagattaaaacattttaggtaatattttaggagtggttagaaaagggttgatcggagaggatgtaaaatattgttacgcaaggggtcagagtggaaagat

SEQ ID NO: 917 - DNA, 200 bp, Conyza canadensis
atctttccactctgaccccttgcgtaacaatattttacatcctctccgatcaacccttttctaaccactcctaaaatattacctaaaatgttttaatctaaaacctcttgtaagaatatataacagggataataatactaaattattaaccaaccaaaacactagggtggaggtccattgattggggatgtctctaaaag

SEQ ID NO: 918 - DNA, 200 bp, Conyza canadensis
acgcaaggggtcagagtggaaagataaaggccggtatagtctttcataggagtttgtgtcctcgaaattcacccaagaactttgtctttgtgctgtcgtacctttttctttttctttcccttttgtctgttactactccgtattaactgacgttttaatattgtttagcttaactaaatagattattggaggattagtat

SEQ ID NO: 919 - DNA, 200 bp, Conyza canadensis
atactaatcctccaataatctatttagttaagctaaacaatattaaaacgtcagttaatacggagtagtaacagacaaaagggaaagaaaaagaaaaaggtacgacagcacaaagacaaagttcttgggtgaatttcgaggacacaaactcctatgaaagactataccggcctttatctttccactctgaccccttgcgt

SEQ ID NO: 920 - DNA, 200 bp, Conyza canadensis
aaatagattattggaggattagtatttgttgtttagtcattaattgaaggtgaatcaagatccgaataaatgaatctaaaacctatttgcttagtcataaatcttcaagaaaagatgaattgttttgcttaattttaatccttaaagcaaacatgaattgaactcttaataaaaaagagctaggtatttatgacggttat

SEQ ID NO: 921 - DNA, 200 bp, Conyza canadensis
ataaccgtcataaatacctagctcttttttattaagagttcaattcatgtttgctttaaggattaaaattaagcaaaacaattcatcttttcttgaagatttatgactaagcaaataggttttagattcatttattcggatcttgattcaccttcaattaatgactaaacaacaaatactaatcctccaataatctattt

SEQ ID NO: 922 - DNA, 200 bp, Conyza canadensis
agagctaggtatttatgacggttattggctgctttaattaagctctttgtctgcatatcccgagtctatccaaatcatcaccccattatgctgtcggtgcttttaggacaaaatcattagtgttaagttcagtcttttaaaaccgttataaagctacaaatattagattcatcttctctacagagaggtgtatcttacat

SEQ ID NO: 923 - DNA, 200 bp, Conyza canadensis
atgtaagatacacctctctgtagagaagatgaatctaatatttgtagctttataacggttttaaaagactgaacttaacactaatgattttgtcctaaaagcaccgacagcataatggggtgatgatttggatagactcgggatatgcagacaaagagcttaattaaagcagccaataaccgtcataaatacctagctct

SEQ ID NO: 924 - DNA, 200 bp, Conyza canadensis
ctctacagagaggtgtatcttacattcttacacttaaaacggataaacagatgaattttttcttattttggtaattttttcgaactttttcactagtcgcttctaagattgtatataatgagattcgaacttgagacacccaattaaggatttgtgcctcgtaaatacatgagctgaagttaaagccaaatcactctttt

SEQ ID NO: 925 - DNA, 200 bp, Conyza canadensis
aaaagagtgatttggctttaacttcagctcatgtatttacgaggcacaaatccttaattgggtgtctcaagttcgaatctcattatatacaatcttagaagcgactagtgaaaaagttcgaaaaaattaccaaaataagaaaaaattcatctgtttatccgttttaagtgtaagaatgtaagatacacctctctgtagag

SEQ ID NO: 926 - DNA, 200 bp, Conyza canadensis
gaagttaaagccaaatcactcttttcacttctaatacctagtagcatattcatcattcattataaaattttacacgttatagttgttcaattatttatagtcgtcattaacatctgtttgagaagttcatcaatttccagtacactggtaatcacttaaaaataattggagtcgtctgtagtcccccctcatatgtgagt

SEQ ID NO: 927 - DNA, 200 bp, Conyza canadensis
actcacatatgaggggggactacagacgactccaattatttttaagtgattaccagtgtactggaaattgatgaacttctcaaacagatgttaatgacgactataaataattgaacaactataacgtgtaaaattttataatgaatgatgaatatgctactaggtattagaagtgaaaagagtgatttggctttaacttc

SEQ ID NO: 928 - DNA, 200 bp, Conyza canadensis
ctgtagtcccccctcatatgtgagtactttttaaattcaagaggacccatagatctttaactacatttattgatttatacattatttcatatagcattttctgcagatacgatttgttatgtagcaacatagacccatgttcagtccaaacatactagtacaattttggagcaatgcaataatgagtatctaaagtttca

SEQ ID NO: 929 - DNA, 200 bp, Conyza canadensis
tgaaactttagatactcattattgcattgctccaaaattgtactagtatgtttggactgaacatgggtctatgttgctacataacaaatcgtatctgcagaaaatgctatatgaaataatgtataaatcaataaatgtagttaaagatctatgggtcctcttgaatttaaaaagtactcacatatgaggggggactacag

SEQ ID NO: 930 - DNA, 200 bp, Conyza canadensis
gcaataatgagtatctaaagtttcatgtgagaataatcaattacttagacactagacgttttttaacaatcagtttgttcctggtacattggcaccaactcgtctgagccttcagcgcgttggccagcaagtagtttcggtttggtggtcactgtcgagcaattgggcacgttaagtattttttttacattttttatttc

SEQ ID NO: 931 - DNA, 200 bp, Conyza canadensis
gaaataaaaaatgtaaaaaaaatacttaacgtgcccaattgctcgacagtgaccaccaaaccgaaactacttgctggccaacgcgctgaaggctcagacgagttggtgccaatgtaccaggaacaaactgattgttaaaaaacgtctagtgtctaagtaattgattattctcacatgaaactttagatactcattattgc

SEQ ID NO: 932 - DNA, 200 bp, Conyza canadensis
atttttttatttaaaagtatatttaaaattttttgcccacaccaaaaaaaaatttaaaaaaaaagaagtacatatgcaatcaatgacatgcgatttcaatcccaactttcaaatctcaatttttaaatgctagtagctataagtaaataatctccattctccttctctatacatcttttcttattcaacaggtaatactt

SEQ ID NO: 933 - DNA, 200 bp, Conyza canadensis
aagtattacctgttgaataagaaaagatgtatagagaaggagaatggagattatttacttatagctactagcatttaaaaattgagatttgaaagttgggattgaaatcgcatgtcattgattgcatatgtacttctttttttttaaatttttttttggtgtgggcaaaaaattttaaatatacttttaaataaaaaaat

SEQ ID NO: 934 - DNA, 200 bp, Conyza canadensis
ttttcttattcaacaggtaatactttcatttattaatcataaaattatacatatatattttccctaatttttaggtttcttaatttcttttgacgtgaattgaaagatgaaaacgtgatgatagattggaagagccgaagaggggttttgttttggggaatctcacacataacacactaaacaacatattatcagttatc

SEQ ID NO: 935 - DNA, 200 bp, Conyza canadensis
gataactgataatatgttgtttagtgtgttatgtgtgagattccccaaaacaaaacccctcttcggctcttccaatctatcatcacgttttcatctttcaattcacgtcaaaagaaattaagaaacctaaaaattagggaaaatatatatgtataattttatgattaataaatgaaagtattacctgttgaataagaaaa

SEQ ID NO: 936 - DNA, 200 bp, Conyza canadensis
actaaacaacatattatcagttatcttgtattgatttaatataaaatatgagtactaaaataccattatatggatcgtataagtttagtgaatagttcgtgcttttggttatacgacgaaattgtagttgatttattatatcgtcttttgagtttgcattttggttgtaattggatggttattattttgtgggtatatga

SEQ ID NO: 937 - DNA, 200 bp, Conyza canadensis
tcatatacccacaaaataataaccatccaattacaaccaaaatgcaaactcaaaagacgatataataaatcaactacaatttcgtcgtataaccaaaagcacgaactattcactaaacttatacgatccatataatggtattttagtactcatattttatattaaatcaatacaagataactgataatatgttgtttagt

SEQ ID NO: 938 - DNA, 200 bp, Conyza canadensis
tggttattattttgtgggtatatgaatttattggaatttgatcgatatattaaaatttttgtacctatataatgttttaaatttgtcaccttacgataaagttcctggctctgccttgatagcagccttcatgtaaaattggttttcataaacgttctgagtttttataaattttgtaacatgtcattcttctggaaata

SEQ ID NO: 939 - DNA, 200 bp, Conyza canadensis
tatttccagaagaatgacatgttacaaaatttataaaaactcagaacgtttatgaaaaccaattttacatgaaggctgctatcaaggcagagccaggaactttatcgtaaggtgacaaatttaaaacattatataggtacaaaaattttaatatatcgatcaaattccaataaattcatatacccacaaaataataacca

SEQ ID NO: 940 - DNA, 200 bp, Conyza canadensis
gtaacatgtcattcttctggaaatatgcttctcttcaatttaacgcgtatatgagcgttgcattcgcatataatcgaatgtctcgtggaaagtactaaagacttggccaacgttaggtttcattatcatcttctgggggattgtttaagtccaacataattaagaattttcaaacagaaggaacaacataggaaaagtca

SEQ ID NO: 941 - DNA, 200 bp, Conyza canadensis
tgacttttcctatgttgttccttctgtttgaaaattcttaattatgttggacttaaacaatcccccagaagatgataatgaaacctaacgttggccaagtctttagtactttccacgagacattcgattatatgcgaatgcaacgctcatatacgcgttaaattgaagagaagcatatttccagaagaatgacatgttac

SEQ ID NO: 942 - DNA, 200 bp, Conyza canadensis
agaaggaacaacataggaaaagtcataatcaactgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggta

SEQ ID NO: 943 - DNA, 200 bp, Conyza canadensis
taccatcattgctgaaaatgaaggtctgtaatttttgcagtaatctttaacattgttattatttaaggaagatccatatatgtttgtatgttatagtagttgtttttcaacctcatcttactatatcttagtttaagtactgataaattgactaatcaaactattcagttgattatgacttttcctatgttgttccttct

SEQ ID NO: 944 - DNA, 200 bp, Conyza canadensis
accttcattttcagcaatgatggtatgaagttgaaataatcgtttgttgttttcaattaacattttttcacaaagggagagagataactatggtgatcagctttatatttcaatataatgtgaaaggtctgagaaaaaaatttgaccaagtgtaaaaaatgtgttttggataaataaaagttaatttaaataatctacta

SEQ ID NO: 945 - DNA, 200 bp, Conyza canadensis
tagtagattatttaaattaacttttatttatccaaaacacattttttacacttggtcaaatttttttctcagacctttcacattatattgaaatataaagctgatcaccatagttatctctctccctttgtgaaaaaatgttaattgaaaacaacaaacgattatttcaacttcataccatcattgctgaaaatgaaggt

SEQ ID NO: 946 - DNA, 200 bp, Conyza canadensis
aaaagttaatttaaataatctactaaaattagcccctggtttacaaatatcatttcacttataatttattaaccataatttactaatttgttcagtcaaactttttttttttatatagtttctttatttaacgtactcacaacacattacaatctctcatgttgggtatttttactgctgcattacgtgagttttttttt

SEQ ID NO: 947 - DNA, 200 bp, Conyza canadensis
aaaaaaaaactcacgtaatgcagcagtaaaaatacccaacatgagagattgtaatgtgttgtgagtacgttaaataaagaaactatataaaaaaaaaaagtttgactgaacaaattagtaaattatggttaataaattataagtgaaatgatatttgtaaaccaggggctaattttagtagattatttaaattaactttt

SEQ ID NO: 948 - DNA, 200 bp, Conyza canadensis
tgctgcattacgtgagtttttttttattgtatcatataatttttgacagatgatttttaataaaacaaaccttttcactctttaatggtgaggtttcaactccacagtttaatcaattgccgatcgatgtatatatgtaatttttagttttgatttagtaaatacagaattatttaactagggtataggaagagtagaag

SEQ ID NO: 949 - DNA, 200 bp, Conyza canadensis
cttctactcttcctataccctagttaaataattctgtatttactaaatcaaaactaaaaattacatatatacatcgatcggcaattgattaaactgtggagttgaaacctcaccattaaagagtgaaaaggtttgttttattaaaaatcatctgtcaaaaattatatgatacaataaaaaaaaactcacgtaatgcagca

SEQ ID NO: 950 - DNA, 200 bp, Conyza canadensis
aactagggtataggaagagtagaagacttgaaaatatgggtgataatttcttgattctttcaatttgagtaagttaaaagaaatcttaactcttcaaattttagcatttaatttttatctaaaggttaagattaccataatttggactaatcccctccctaaaaatatatacccattttccttatttgacttggaaaata

SEQ ID NO: 951 - DNA, 200 bp, Conyza canadensis
tattttccaagtcaaataaggaaaatgggtatatatttttagggaggggattagtccaaattatggtaatcttaacctttagataaaaattaaatgctaaaatttgaagagttaagatttcttttaacttactcaaattgaaagaatcaagaaattatcacccatattttcaagtcttctactcttcctataccctagtt

SEQ ID NO: 952 - DNA, 200 bp, Conyza canadensis
ttttccttatttgacttggaaaatagtggggtagatcggatctgacctaacctgatttgacccgatccgacccgaacgttgaaaatgaaaattagtttactagaggtggttcacccacagagaagttataccaaaccgaaacaacccaacaatggcttctccaacaacaactacagatgataacaaaggtagatactatt

SEQ ID NO: 953 - DNA, 200 bp, Conyza canadensis
aatagtatctacctttgttatcatctgtagttgttgttggagaagccattgttgggttgtttcggtttggtataacttctctgtgggtgaaccacctctagtaaactaattttcattttcaacgttcgggtcggatcgggtcaaatcaggttaggtcagatccgatctaccccactattttccaagtcaaataaggaaaa

SEQ ID NO: 954 - DNA, 200 bp, Conyza canadensis
gatgataacaaaggtagatactatttctttttcttcttaataatcttaatatgttattattttcattgtagataatccagttctgcattttgttgcacagagaaagcacctgctaagagagttgcagttgttggtgccggtgtcaggtcaatgttactactttcatatatataatatatgtatcttgcgttttattttac

SEQ ID NO: 955 - DNA, 200 bp, Conyza canadensis
gtaaaataaaacgcaagatacatatattatatatatgaaagtagtaacattgacctgacaccggcaccaacaactgcaactctcttagcaggtgctttctctgtgcaacaaaatgcagaactggattatctacaatgaaaataataacatattaagattattaagaagaaaaagaaatagtatctacctttgttatcatc

SEQ ID NO: 956 - DNA, 200 bp, Conyza canadensis; identical to SEQ ID NO: 836

SEQ ID NO: 957 - DNA, 200 bp, Conyza canadensis; identical to SEQ ID NO: 837

SEQ ID NO: 958 - DNA, 200 bp, Conyza canadensis
tttgaccccaaaaatgctttgcttgtcggaggacatgaccaatatttggaggactaggattagcttagcggaatatggtagataagtaatccttttaggggtactttatataattgtggattgtcatgcatgatacctttcttatatgctcatatgacttctttgcactgttaggggtagtgttctcgacagctaggtga

SEQ ID NO: 959 - DNA, 200 bp, Conyza canadensis
tcacctagctgtcgagaacactacccctaacagtgcaaagaagtcatatgagcatataagaaaggtatcatgcatgacaatccacaattatataaagtacccctaaaaggattacttatctaccatattccgctaagctaatcctagtcctccaaatattggtcatgtcctccgacaagcaaagcatttttggggtcaaa

SEQ ID NO: 960 - DNA, 200 bp, Conyza canadensis
ggtagtgttctcgacagctaggtgacctatgctactttgtttcataggtcgattagggattagcacccactatttttttattttttggaaggcattaaattatattatattaaagataaaaattgccagtaagaaactagccgatacatagactgtccaatccaaaatagaaaactagcacccacattatatgtgggccc

SEQ ID NO: 961 - DNA, 200 bp, Conyza canadensis
gggcccacatataatgtgggtgctagttttctattttggattggacagtctatgtatcggctagtttcttactggcaatttttatctttaatataatataatttaatgccttccaaaaaataaaaaaatagtgggtgctaatccctaatcgacctatgaaacaaagtagcataggtcacctagctgtcgagaacactacc

SEQ ID NO: 962 - DNA, 200 bp, Conyza canadensis
tagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggagac

SEQ ID NO: 963 - DNA, 200 bp, Conyza canadensis
gtctcctcccagcaagtcatagaagcaaataggtttggtagtacgagtggcatgtgcaagaagtcaagaacccctttaacctcctcccagcaagtcacaaaagcaaatagggttggtatcagccatgcatacatagatataagtagatatttactaggaagtcctagggaccggtgggcccacatataatgtgggtgcta

SEQ ID NO: 964 - DNA, 200 bp, Conyza canadensis
cttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagtat

SEQ ID NO: 965 - DNA, 200 bp, Conyza canadensis
atactcttactacattaagagtagacaagggtagaagacataccacatagcccaaattggacaatacatagtaaataagacatttgaacatattaaacatcataaaaacataataaatataaccgtctgcatagaaccaaacatgtgggatgagagcaacaattaataggggcatgtctcctcccagcaagtcatagaag

SEQ ID NO: 966 - DNA, 200 bp, Conyza canadensis
tctactcttaatgtagtaagagtatcatgatactcggtcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttgt

SEQ ID NO: 967 - DNA, 200 bp, Conyza canadensis
acaaaaacaacatgacccaattcttgtgcgaggggtatgggggatgtgagatgtagacagtcttgcctctacccagaggcagaaagactacttccataaggacctccatccaaaaaaggcaaaagtaggagagtgtaaagagttcagtaaccatacctgtcgaccgagtatcatgatactcttactacattaagagtaga

SEQ ID NO: 968 - DNA, 200 bp, Conyza canadensis
aagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatggc

SEQ ID NO: 969 - DNA, 200 bp, Conyza canadensis
gccattcctctagatatcaatcaatcaccatgttgcactagactactatactcaccaatttatttacaaatttcatacatgtaacgaataatcaaaataatatattatactagcagcaaaaaatcaacaatatgtaaaccccattggaaacatcttaccatctgggttcgagtccacaaaaacaacatgacccaattctt

SEQ ID NO: 970 - DNA, 200 bp, Conyza canadensis
attgattgatatctagaggaatggccggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgcca

SEQ ID NO: 971 - DNA, 200 bp, Conyza canadensis
tggcaccctcgtcccatattaaaccgttttgtgaaatgcttcttagtttccctccggctatctcaccggcttcaaaaacagtgacatttattccatgtagttttaacttatatgcagccgcaagcccactgaaacaaaccaagtcattcattcatgattcaacataatatggccggccattcctctagatatcaatcaat

SEQ ID NO: 972 - DNA, 200 bp, Conyza canadensis
ggtttaatatgggacgagggtgccaatactatggtatgatatcgatgttagtttgcttatagatatagacataacttacttctttttttttattttttttaaaaaaaagttgttttgatgctcttttactccgtatttgtagactgagagtgaaccggatgtcagcaggttgcttgatgatcttggtcttcgagataaac

SEQ ID NO: 973 - DNA, 200 bp, Conyza canadensis
gtttatctcgaagaccaagatcatcaagcaacctgctgacatccggttcactctcagtctacaaatacggagtaaaagagcatcaaaacaacttttttttaaaaaaaataaaaaaaaagaagtaagttatgtctatatctataagcaaactaacatcgatatcataccatagtattggcaccctcgtcccatattaaacc

SEQ ID NO: 974 - DNA, 200 bp, Conyza canadensis
gatgatcttggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccact

SEQ ID NO: 975 - DNA, 200 bp, Conyza canadensis
agtggatttagccttccgtatttgaacacgaataaaagtgatataaacaatttcctcttctttatactatgtcatttagtatacaatgggagaaatttgcaaaaataaattttcaaacgcacgctacaggaagcatgatgttccatatccaacagcatataacttacagactgttgtttatctcgaagaccaagatcatc

SEQ ID NO: 976 - DNA, 200 bp, Conyza canadensis
tcaaatacggaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgat

SEQ ID NO: 977 - DNA, 200 bp, Conyza canadensis
atcataccagtaccggttttccatttcttacaatatatcgcttatgttgggaaagtggctgcaaaaggaaatatagtgtagtattcagccatggtaaacatatacacacatgaccacaacaaataaatgaaacaagaaccatagccgacaaattattacagccacagccacataaagtggatttagccttccgtatttga

SEQ ID NO: 978 - DNA, 200 bp, Conyza canadensis
aatggaaaaccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttgg

SEQ ID NO: 979 - DNA, 200 bp, Conyza canadensis
ccaaaatcagtttacaaaactttgtaaacaaatgacaagtgtttatgaggttgagaatttgagtccaataaaacacaatttctactaatgattttgaagtaaagtttcatcttatacttttaaactcttttgttcatatataacagaggattagttttcagcatggtgttgagatatcataccagtaccggttttccatt

SEQ ID NO: 980 - DNA, 200 bp, Conyza canadensis
acaaagttttgtaaactgattttggttttctgggaatgtaaataattatggcagtttattgtactgttctttcgtatagatagttataaactcaaaacacaaaaaaaaaggttgttttattacgcggtcgtagctgtcacaattttagttttcttttgtacttgccaagttcatgtcttatatactgaatgtaacttggc

SEQ ID NO: 981 - DNA, 200 bp, Conyza canadensis
gccaagttacattcagtatataagacatgaacttggcaagtacaaaagaaaactaaaattgtgacagctacgaccgcgtaataaaacaacctttttttttgtgttttgagtttataactatctatacgaaagaacagtacaataaactgccataattatttacattcccagaaaaccaaaatcagtttacaaaactttgt

SEQ ID NO: 982 - DNA, 200 bp, Conyza canadensis
tcttatatactgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggct

SEQ ID NO: 983 - DNA, 200 bp, Conyza canadensis
agccttgacattgagaatcattgggtagataatatgagaatgaaaggattggatacggtttaaatacttcagacttaaacatccaagagctactaacgaacctttgattgagtggaaagcaaactgctttggatcagtgcaatggggttagaaggtacctgcagacatgagtttggccaagttacattcagtatataaga

SEQ ID NO: 984 - DNA, 200 bp, Conyza canadensis
cccaatgattctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttc

SEQ ID NO: 985 - DNA, 200 bp, Conyza canadensis
gaagtacaaattataattttgagatcatctgatatcaaaatgagaaagaatttgtgtaactcgtgtgctaatatattaccattgcaattttggataattttttaaatacaaccgaaaagggcatgcatcatttttattaaaaatttaaagcatagtaggataaagagtttttgtgagccttgacattgagaatcattggg

SEQ ID NO: 986 - DNA, 200 bp, Conyza canadensis
atctcaaaattataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaactttttatttatttac

SEQ ID NO: 987 - DNA, 200 bp, Conyza canadensis
gtaaataaataaaaagttagtccctaatagggtttaacagatagataggaaagaaggctatatattacctttcttgtgtatcagacgagttcttcttcttccatgaaaatggctccaaaagtatttgaagctgtaatttttgcaacaaaccccataatcacatacacaatgtaatgaagtacaaattataattttgagat

SEQ ID NO: 988 - DNA, 200 bp, Conyza canadensis
agggactaactttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatctta

SEQ ID NO: 989 - DNA, 200 bp, Conyza canadensis
taagatagcggaaagcatggacaaattttgaagtaccacacaaatgaaaacttggaccccttaatatcaaaagaaagacgtataccagaataactgaactgaagataaaggttacaatatacatatacctccttcccaaaatgacgttgaaagaatgcaccaacactacaaaatagtaaataaataaaaagttagtccct

SEQ ID NO: 990 - DNA, 200 bp, Conyza canadensis
tttgtccatgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaac

SEQ ID NO: 991 - DNA, 200 bp, Conyza canadensis
gtttttgtttgttaattgaaatcagttatgtatatccccacactaatatgaagcagcatggacatggaagagttactcacagaaagtgactccggatctccaccgcttgttccagcaacaacaggattaatgagatactcaacaaccttacatatgtacattaagtatagaaaattaagatagcggaaagcatggacaaa

SEQ ID NO: 992 - DNA, 200 bp, Conyza canadensis
ctgatttcaattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgt

SEQ ID NO: 993 - DNA, 200 bp, Conyza canadensis
acatattattttgtagcttacataccttctctctaaatcccataattcagggaatgaatagcgcatctgtatggaaaatatgaggttgatagattaacctagaaggttaatgatgagaggtagcacttagcaggggtgtcaaagaatgcatttgcacctccacatgctttaaagtgtttttgtttgttaattgaaatcag

SEQ ID NO: 994 - DNA, 200 bp, Conyza canadensis
gtatgtaagctacaaaataatatgtaattcattctttaagtgagcttgattatttgttcccatgcaatctactatgattttttattataatatttataaagcttggattcttaaattcaatgtgatgatggtcaaatcaacatgcaggtttggttcactcatttctggggcatttcagtctatgatctcttctcgaggca

SEQ ID NO: 995 - DNA, 200 bp, Conyza canadensis
tgcctcgagaagagatcatagactgaaatgccccagaaatgagtgaaccaaacctgcatgttgatttgaccatcatcacattgaatttaagaatccaagctttataaatattataataaaaaatcatagtagattgcatgggaacaaataatcaagctcacttaaagaatgaattacatattattttgtagcttacatac

SEQ ID NO: 996 - DNA, 200 bp, Conyza canadensis
cagtctatgatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatct

SEQ ID NO: 997 - DNA, 200 bp, Conyza canadensis
agatttaaaagaacaaagtaagcaatatattgatggcctgtttctactttaaagaatatattagattccaataaatgaatcttgacagacaaaatcaccaatcttacctgcattccacctaaaaatgaaaaggagccacgcctgcgcttgctgcttcctgaaggactcttttttctgcctcgagaagagatcatagactg

SEQ ID NO: 998 - DNA, 200 bp, Conyza canadensis
ttgcttactttgttcttttaaatctttattctcatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttga

SEQ ID NO: 999 - DNA, 200 bp, Conyza canadensis
tcaaaaggttgctgatttaattgtttgttctgatctggagcacaatagatcgaccaattcccagtagtgttatcatcacagctataggacatttcaagcaccttggattgaagattaagttcatgttgtccaacttctttgctcagtgcatttgtaagtgtctgcatgagaataaagatttaaaagaacaaagtaagcaa

SEQ ID NO: 1000 - DNA, 200 bp, Conyza canadensis
aacaattaaatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattc

SEQ ID NO: 1001 - DNA, 200 bp, Conyza canadensis
gaatttccatattttgtccacagatttgaatatttgatgaatccagatccaccaagatagcacaaaaaaaagttgctgagacaaactagtcttgtcaaaatgcaaaacattaaccaaatttatgtcaatgtcaccgtaagataacacaactatactcacagtcatgatcacagcatcaaaaggttgctgatttaattgtt

SEQ ID NO: 1002 - DNA, 200 bp, Conyza canadensis
atctgtggacaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtctgttcctgct

SEQ ID NO: 1003 - DNA, 200 bp, Conyza canadensis
agcaggaacagacttcctgtctttgtaatcttcatttctttcacattgccaagtggggcctaattcgggagcatgtactgtgttaattacgttctaattgcacttacaaactaataagcattaaaacaaatgggtgtataaacaataattctcctatttctgaaatagagaataagaatttccatattttgtccacagat

SEQ ID NO: 1004 - DNA, 200 bp, Conyza canadensis
caaagacaggaagtctgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtt

SEQ ID NO: 1005 - DNA, 200 bp, Conyza canadensis
aactggcatataactaagctgcattataaaaaccagaaaatattcctttaaaggatatctccccatggtaaagattattgtttaaatttcaaaagagctaaaactaaggggttctgcacgaattccatatgatagaactcacacggtacaataacatacctcaggtataaaattgagcaggaacagacttcctgtctttg

SEQ ID NO: 1006 - DNA, 200 bp, Conyza canadensis
aatgcagcttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcatttttttttcttt

SEQ ID NO: 1007 - DNA, 200 bp, Conyza canadensis
aaagaaaaaaaaatgaaaaaaaaatgaaaaggaaaaaaaaaaaaaagataatacacaggcaagctttacctaacgtcttcaaaccattttcctgctccttggcaggaacaagcattccaaatccctcaaggggccgcttcacattctctttcttgaatgtagagattatgactgaaactggcatataactaagctgcatt

SEQ ID NO: 1008 - DNA, 200 bp, Conyza canadensis
atttttttttcatttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgc

SEQ ID NO: 1009 - DNA, 200 bp, Conyza canadensis
gcagaaattattgcaatgatcaagcctacctcgaagcattggccagttctttgtttcgacttcccccaacaaaggtggtataaagatacaagtcttcaggggcacgatctggaaacatcatggaagaaaagagagtgcctgcataacagaattttcaataataattatagacaataaagaaaaaaaaatgaaaaaaaaat

SEQ ID NO: 1010 - DNA, 200 bp, Conyza canadensis
gcttgatcattgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaa

SEQ ID NO: 1011 - DNA, 200 bp, Conyza canadensis
ttcctccaaaaaagtttccaaactaaattattacttactcatcataatcatcataaataatagattgatattcctatagggaatggtcaagaagattctcttatgaagtttttagagacagccattatacaactacttcctcaatacttgagtaaatttgaagctaaaatattgagcagaaattattgcaatgatcaagc

SEQ ID NO: 1012 - DNA, 200 bp, Conyza canadensis
tagtttggaaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaag

SEQ ID NO: 1013 - DNA, 200 bp, Conyza canadensis
cttacgtcaaaaattgtggctctccctctgctccaagcaactgtctgaggtcagaagttactatctgcttcaactcatccctgtatttacagaaaatatatattattgcaagaattatacttgagttatgtcctctccccttaaacagcaacaagaaagctccaacatttctcctttcctccaaaaaagtttccaaacta

SEQ ID NO: 1014 - DNA, 200 bp, Conyza canadensis
ggagagccacaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttt

SEQ ID NO: 1015 - DNA, 200 bp, Conyza canadensis
aaaaaaagttaaatttcaagaaacaatttcaattggtgaacatgcgccaatgaaaaagtctaagctgaaaattaagttgtgtaattgtttgtatagtgctcaggaatgcaattcttgcaatcctttgatctagataaactaacgtttaataaaagcagcagagctagaatgtgtccttacgtcaaaaattgtggctctcc

SEQ ID NO: 1016 - DNA, 200 bp, Conyza canadensis
tgtttcttgaaatttaacttttttttaaaagcccgaggttcacagatacttgtacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagca

SEQ ID NO: 1017 - DNA, 200 bp, Conyza canadensis
tgcttccataactaagccatagtcacgcccgtacaatggatatgctttgctccagtaatagtgactgcaattaaactacatcattatcatgtatgacatgaacaaaaaaacacaagacaaattaagcataagctacttgtacattgtacaagtatctgtgaacctcgggcttttaaaaaaaagttaaatttcaagaaaca

SEQ ID NO: 1018 - DNA, 200 bp, Conyza canadensis
tgactatggcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttat

SEQ ID NO: 1019 - DNA, 200 bp, Conyza canadensis
ataaaggttttatgtataagtaggggtattttaggaagaaaaaaaatgcttaattttaagaaatctaatactctttataagggagtatagatatgtatatatctactttatttcaaacacaaaaaggtttacccgcataaaagtaaccaggtagctctctttccatcttctcaattgcttccataactaagccatagtca

SEQ ID NO: 1020 - DNA, 200 bp, Conyza canadensis
ccctacttatacataaaacctttatatatcatcctttcccacattgtctctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaa

SEQ ID NO: 1021 - DNA, 200 bp, Conyza canadensis
ttttaatacgagcatagtgtccgcgcgttgcaacggctaaaaggcgatgacaatataaaagggaggcggtggtggagatcgagggcggtggtggagaaggagggcggcggcggagggtgatagaaggtcgaggagagcgtgtaatgattagagacaatgtgggaaaggatgatatataaaggttttatgtataagtaggg

SEQ ID NO: 1022 - DNA, 200 bp, Conyza canadensis
cgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttt

SEQ ID NO: 1023 - DNA, 200 bp, Conyza canadensis
aaaagattaagaatttgactaccatagacaaatagtttagttcagtttggacccgttcgacttacactctagagtgaatgattttagcttaaatatatattcatcagtacaaaatcataacaaaataatgaaatatataaactttacgtaaactttatgtttattacgttactacttttaatacgagcatagtgtccgcg

SEQ ID NO: 1024 - DNA, 200 bp, Conyza canadensis
atggtagtcaaattcttaatctttttggtatcgatcgttgtgtagtgttgcacacctcacttgatattagttttatgtgattatatatggttaatttaatttttctttgatttttgatcatggtcttaaatatcattaaaggtgaagaaacatgtgaagagggataaatttggagaaagaatggcatcactaaaacagat

SEQ ID NO: 1025 - DNA, 200 bp, Conyza canadensis
atctgttttagtgatgccattctttctccaaatttatccctcttcacatgtttcttcacctttaatgatatttaagaccatgatcaaaaatcaaagaaaaattaaattaaccatatataatcacataaaactaatatcaagtgaggtgtgcaacactacacaacgatcgataccaaaaagattaagaatttgactaccat

SEQ ID NO: 1026 - DNA, 200 bp, Conyza canadensis
aaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtataca

SEQ ID NO: 1027 - DNA, 200 bp, Conyza canadensis
tgtataccattctattgtgttgtaactataacccttacaactatgtttagcaaaatcctacttgtatagattggaaatcaaaacaactagtatacatatatgatatacctaatcaaacaaattacatataattaataaacttaaagaaggactaaccttgccatagggtgacactatctgttttagtgatgccattcttt

SEQ ID NO: 1028 - DNA, 200 bp, Conyza canadensis
ttacaacacaatagaatggtatacatacattatatatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcgtacaggagtctagact

SEQ ID NO: 1029 - DNA, 200 bp, Conyza canadensis
agtctagactcctgtacgatcaacattaacacaccgtctaagcaaccatatacttacatcgactatgctattcatagcctttaaggatatggataaagcaaagtaaattggtttacatgacggttaaagattattattaataaacagttatatatctttatatatatataatgtatgtataccattctattgtgttgtaa

SEQ ID NO: 1030 - DNA, 200 bp, Conyza canadensis
tgttgatcgtacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatt

SEQ ID NO: 1031 - DNA, 200 bp, Conyza canadensis
aatcttcatacacacatgtcactcatctctataggtatgagtaatcaagcctatttcgatgtatgtaacagaaattgttggttaaatttgaatgatattataactatgctcttaaaaataaaggaagttttacctttgcgttcgattcccttcttctctaaaacacaatggtccaagtctagactcctgtacgatcaaca

SEQ ID NO: 1032 - DNA, 200 bp, Conyza canadensis
tgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagaga

SEQ ID NO: 1033 - DNA, 200 bp, Conyza canadensis
tctctaccaatgatgtagtgtttggtaaaattaactattttatatcatctgaattccaccaagaagatgtccaactgtaattttgtaatggacatacaacaaagaaaaaaaccgcaaaccataattaactagtacattagaaatgggaaaatgatatcctacaattcaatatataaatcttcatacacacatgtcactca

SEQ ID NO: 1034 - DNA, 200 bp, Conyza canadensis
ccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaa

SEQ ID NO: 1035 - DNA, 200 bp, Conyza canadensis
tttattcaagatgtttgtactgttttattagtggttcatggttggattaacaaataatagaacattgtgtcaaatctgttgtaattggaaatctgcgaattgcaaaagacaacattttatgtaatacgagtatctcttttgaaacttacaaaccatttatctacgttctaatttctctctaccaatgatgtagtgtttgg

SEQ ID NO: 1036 - DNA, 200 bp, Conyza canadensis
aaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgta

SEQ ID NO: 1037 - DNA, 200 bp, Conyza canadensis
tacgtgtatgcttttaatttgaaaagctatgattggaaagaagagagaaagttggatgtgcatttttgaacctttttaagctagaataagaataaaatacatgttttttgatattactggtcattatatggagacaaaaagcatacaacaatcaataatgtattggtggcttttttttattcaagatgtttgtactgttt

SEQ ID NO: 1038 - DNA, 200 bp, Conyza canadensis
ttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaac

SEQ ID NO: 1039 - DNA, 200 bp, Conyza canadensis
gttgggagtttggtttgtttggttggtttttggtgaggtgccataaagttacttaaatatgtagtaggtacaaaaaacaaattggggtccaaggatgggaggtgatgcagagcacgtgacatggttaaccaactaccccccacacacatatcaatctacatccatatgtttcttttacgtgtatgcttttaatttgaaaa

SEQ ID NO: 1040 - DNA, 200 bp, Conyza canadensis
caaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgtt

SEQ ID NO: 1041 - DNA, 200 bp, Conyza canadensis
aacagctgaatcaaatcaagaatttgcttctttttttagctggtttgaaaagagacagacattgacaacaacaacaaaattgtgattaaaaacaagaaaattggaatgacagaaatctgggagagatgtaagtacttgttgaggtatatgtgtgtgtgcaattaagtgatgtatagttgggagtttggtttgtttggttg

SEQ ID NO: 1042 - DNA, 200 bp, Conyza canadensis
aaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgt

SEQ ID NO: 1043 - DNA, 200 bp, Conyza canadensis
acataaacccagtaaaaagattcaatctttacatacccaactctacttttttgctaaactcaacaaaactgataaaaacccggttcaaaaaacacaggaatttgaagaaattaactcaaagatttaaacttggggggtgaaagaatgagaaagactaaccataaacaagtggaacaacagctgaatcaaatcaagaattt

SEQ ID NO: 1044 - DNA, 200 bp, Conyza canadensis
ttgaatctttttactgggtttatgtaatttctttgaaatttataagtttcttgcaatgggtatatgattttctattgattgaagtggttaataacaggatttggtgagtaaagtttgaatctttcgagttatggatttatgtcataccttttcttgcccttcaaaataaagtcaaagctttagttttgtgatttgacttt

SEQ ID NO: 1045 - DNA, 200 bp, Conyza canadensis
aaagtcaaatcacaaaactaaagctttgactttattttgaagggcaagaaaaggtatgacataaatccataactcgaaagattcaaactttactcaccaaatcctgttattaaccacttcaatcaatagaaaatcatatacccattgcaagaaacttataaatttcaaagaaattacataaacccagtaaaaagattcaa

SEQ ID NO: 1046 - DNA, 200 bp, Conyza canadensis
agctttagttttgtgatttgactttggtatcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatt

SEQ ID NO: 1047 - DNA, 200 bp, Conyza canadensis
aattgaagtaatcactaatcacattaaaactttatcaggaaacaaatataacaaaattgaatttatcaaaatatatattacaatttacaaacagcatgaaaatattcatgggagcaacagcataccaaagtcaaatcacaaaactaaagctttgactttattttgaagggataccaaagtcaaatcacaaaactaaagct

SEQ ID NO: 1048 - DNA, 200 bp, Conyza canadensis
cgattcgagttcccggccattgctcgattgcgtggtcgtcggcgccggaattagcggactgtgtatagcgcaagcgttgtcaacgaagcacggcggcgacgtggtcgtgacagaggcgcgtgagagagttggaggaaatatatcgacagttgaaagagatggttatttatgggaagaaggtcctaatagctttcaaccct

SEQ ID NO: 1049 - DNA, 200 bp, Conyza canadensis
agggttgaaagctattaggaccttcttcccataaataaccatctctttcaactgtcgatatatttcctccaactctctcacgcgcctctgtcacgaccacgtcgccgccgtgcttcgttgacaacgcttgcgctatacacagtccgctaattccggcgccgacgaccacgcaatcgagcaatggccgggaactcgaatcg

SEQ ID NO: 1050 - DNA, 200 bp, Conyza canadensis
gaaggtcctaatagctttcaaccctccgatcctatgcttactatggtggtggacagtggattgaaggatgatttggtgttgggtgatccaactgcacctcggtttgtgttatgggatggtgatctgaagccggtgccttccagtccatctgatttgcctacctttgatctgatgagccttggtgggaaactccgagccgg

SEQ ID NO: 1051 - DNA, 200 bp, Conyza canadensis
ccggctcggagtttcccaccaaggctcatcagatcaaaggtaggcaaatcagatggactggaaggcaccggcttcagatcaccatcccataacacaaaccgaggtgcagttggatcacccaacaccaaatcatccttcaatccactgtccaccaccatagtaagcataggatcggagggttgaaagctattaggaccttc

SEQ ID NO: 1052 - DNA, 200 bp, Conyza canadensis
gccttggtgggaaactccgagccggttttggggctcttggaatccgccctccacctccagaccgtgaggaatctgttgaagagtttgtccggcgtaatcttggtgatgaagtttttgaacgtttgattgaaccattttgctcaggtgtttacgcgggggatccatcaaaacttagtatgaaagcagcatttggaaaggtt

SEQ ID NO: 1053 - DNA, 200 bp, Conyza canadensis
aacctttccaaatgctgctttcatactaagttttgatggatcccccgcgtaaacacctgagcaaaatggttcaatcaaacgttcaaaaacttcatcaccaagattacgccggacaaactcttcaacagattcctcacggtctggaggtggagggcggattccaagagccccaaaaccggctcggagtttcccaccaaggc

SEQ ID NO: 1054 - DNA, 200 bp, Conyza canadensis
tatgaaagcagcatttggaaaggtttggaagctggagcaaaatggtggtagcattgttgggggagcatttaaagcaatccaagctaaaaataagagtaccaagcctcctcgagacccgagattaccaacaccgaagggccaaactgttggatcttttaggaagggacaagcaatgttgcctaatgccatctcaaaagggt

SEQ ID NO: 1055 - DNA, 200 bp, Conyza canadensis
acccttttgagatggcattaggcaacattgcttgtcccttcctaaaagatccaacagtttggcccttcggtgttggtaatctcgggtctcgaggaggcttggtactcttatttttagcttggattgctttaaatgctcccccaacaatgctaccaccattttgctccagcttccaaacctttccaaatgctgctttcata

SEQ ID NO: 1056 - DNA, 200 bp, Conyza canadensis
ttgcctaatgccatctcaaaagggttgggtagcagagtgaagttatcctgggagctcgtaggtatcactaaatctgagaatagagggtatagtttgacatatcgaacaccagatggattggaaagtctgcagactaaaactgttgtcatgactgttccatcctatgtggctagtgacttgttgcgtcctctttcggtgga

SEQ ID NO: 1057 - DNA, 200 bp, Conyza canadensis
tccaccgaaagaggacgcaacaagtcactagccacataggatggaacagtcatgacaacagttttagtctgcagactttccaatccatctggtgttcgatatgtcaaactataccctctattctcagatttagtgatacctacgagctcccaggataacttcactctgctacccaacccttttgagatggcattaggcaa

SEQ ID NO: 1058 - DNA, 200 bp, Conyza canadensis
acttgttgcgtcctctttcggtggaagcagcagatgctttgtcaaaattttattatcccccggttgcagctgtatctgtttcctatccaaaagaggcaattcgtgcggaccgtttgattgacggtcagctcaagggttttggtcagttgcatccacgaagtcagggcgtggagactctaggtaccatatacagttcgtct

SEQ ID NO: 1059 - DNA, 200 bp, Conyza canadensis
agacgaactgtatatggtacctagagtctccacgccctgacttcgtggatgcaactgaccaaaacccttgagctgaccgtcaatcaaacggtccgcacgaattgcctcttttggataggaaacagatacagctgcaaccgggggataataaaattttgacaaagcatctgctgcttccaccgaaagaggacgcaacaagt

SEQ ID NO: 1060 - DNA, 200 bp, Conyza canadensis
tctaggtaccatatacagttcgtctcttttccctaaccgtgctccacctggaagggttctgctcctgaactacattggaggggctacaaatcctggtattttatcaaagacggagagtcaaattgttgaagcagttgatcgcgacctacggaagatgctgataaatcctaaagcaggagagccattgaccttaggagtga

SEQ ID NO: 1061 - DNA, 200 bp, Conyza canadensis
tcactcctaaggtcaatggctctcctgctttaggatttatcagcatcttccgtaggtcgcgatcaactgcttcaacaatttgactctccgtctttgataaaataccaggatttgtagcccctccaatgtagttcaggagcagaacccttccaggtggagcacggttagggaaaagagacgaactgtatatggtacctaga

SEQ ID NO: 1062 - DNA, 200 bp, Conyza canadensis
ggagagccattgaccttaggagtgaaagtgtggcctcgagcgatcccacagtttctgattggtcattatgacattttagaggctgctaaatgtgctcttagtcttgctggataccggggtatgtttcttggagggaactatgtatctggtgtagctttaggtagatgtgtggagaatgcctatgaggttgcagccgatgt

SEQ ID NO: 1063 - DNA, 200 bp, Conyza canadensis
acatcggctgcaacctcataggcattctccacacatctacctaaagctacaccagatacatagttccctccaagaaacataccccggtatccagcaagactaagagcacatttagcagcctctaaaatgtcataatgaccaatcagaaactgtgggatcgctcgaggccacactttcactcctaaggtcaatggctctcc

SEQ ID NO: 1064 - DNA, 200 bp, Conyza canadensis
atgcctatgaggttgcagccgatgtaagtaattttttgtcacggggcgtgtacaagtaatacgtcactcttcggaaattagtgtttatgaggttagtaattaaagttttggcacaaggcatgtggaagtgaaaacgcggactttcagtgaagttagtcatctattctcaagcctcatggctaaatgtaattcgagttaat

SEQ ID NO: 1065 - DNA, 200 bp, Conyza canadensis
attaactcgaattacatttagccatgaggcttgagaatagatgactaacttcactgaaagtccgcgttttcacttccacatgccttgtgccaaaactttaattactaacctcataaacactaatttccgaagagtgacgtattacttgtacacgccccgtgacaaaaaattacttacatcggctgcaacctcataggcat

SEQ ID NO: 1066 - DNA, 200 bp, Conyza canadensis
cgtcaccatactgccacggtcgccacaccttcgtctctatcactatcaccgtcgcatcgcacggacatcatctagtcaatatttatttatgaggaatggagatatatctatactttcatattaaattaaactgcctatttttttcaactattctacctttgaaatgcctattataccctcctataaacaactatccattc

SEQ ID NO: 1067 - DNA, 200 bp, Conyza canadensis
gaatggatagttgtttataggagggtataataggcatttcaaaggtagaatagttgaaaaaaataggcagtttaatttaatatgaaagtatagatatatctccattcctcataaataaatattgactagatgatgtccgtgcgatgcgacggtgatagtgatagagacgaaggtgtggcgaccgtggcagtatggtgacg

SEQ ID NO: 1068 - DNA, 200 bp, Conyza canadensis
ccctcctataaacaactatccattctactcttttaattgattttctcgtactacccttccatctatttcccaatacttatccctaatctctaatcccctcctctcttgctgtcgccgaaaacctaatagaaaaattagtttcatttctacggcaactaccataaacctacaaaaagattggttttatctctccctcacca

SEQ ID NO: 1069 - DNA, 200 bp, Conyza canadensis
tggtgagggagagataaaaccaatctttttgtaggtttatggtagttgccgtagaaatgaaactaatttttctattaggttttcggcgacagcaagagaggaggggattagagattagggataagtattgggaaatagatggaagggtagtacgagaaaatcaattaaaagagtagaatggatagttgtttataggaggg

SEQ ID NO: 1070 - DNA, 200 bp, Conyza canadensis
gattggttttatctctccctcaccaccaccaccacaaatcacccattccttacaagctctcaaatcggttaggtgattttccattgaaatcgcttgtttttattttattttattatatctaatttcctaatttaaatccattgtttttgtatttttcccaattttctttttgaatttggtttgggttaatgttctgatca

SEQ ID NO: 1071 - DNA, 200 bp, Conyza canadensis
tgatcagaacattaacccaaaccaaattcaaaaagaaaattgggaaaaatacaaaaacaatggatttaaattaggaaattagatataataaaataaaataaaaacaagcgatttcaatggaaaatcacctaaccgatttgagagcttgtaaggaatgggtgatttgtggtggtggtggtgagggagagataaaaccaatc

SEQ ID NO: 1072 - DNA, 200 bp, Conyza canadensis
ttggtttgggttaatgttctgatcatccatgtattttgttcgtacattcacaaaagaaaaaggtaccgacacatttaatgatcacttttttaaaggtaccgtcgcatcatgtgggtacccatctagctagttgatgaataaattattagtattgttaaatttaagttttttgtttaatgagtaatttaagagtatgttta

SEQ ID NO: 1073 - DNA, 200 bp, Conyza canadensis
taaacatactcttaaattactcattaaacaaaaaacttaaatttaacaatactaataatttattcatcaactagctagatgggtacccacatgatgcgacggtacctttaaaaaagtgatcattaaatgtgtcggtacctttttcttttgtgaatgtacgaacaaaatacatggatgatcagaacattaacccaaaccaa

SEQ ID NO: 1074 - DNA, 200 bp, Conyza canadensis
aatgagtaatttaagagtatgtttaaatttgggttaaaaaaaaaagaaaaaaaaagtaaatgtgtattgatttgtaagttgtaaccgtctaatattataaaaagaaaaagagaaaccactcctatataaaacagtcaagcctcttgtatcattaaccgggttgatttaagagcgaactttgatcgaattttgggttttcg

SEQ ID NO: 1075 - DNA, 200 bp, Conyza canadensis
cgaaaacccaaaattcgatcaaagttcgctcttaaatcaacccggttaatgatacaagaggcttgactgttttatataggagtggtttctctttttctttttataatattagacggttacaacttacaaatcaatacacatttactttttttttcttttttttttaacccaaatttaaacatactcttaaattactcatt

SEQ ID NO: 1076 - DNA, 200 bp, Conyza canadensis
actttgatcgaattttgggttttcgaatttgctttccatccacatcgatatctgcccaagtaagaaaccctcgttcctgtctctctttaatttacatctccatgtgcttttcgatcctaattataaatatgcggataaccgcagcattactacccgacgcccaaaggaagaggaaaaagtcgtcgtcaaaggcagatcaa

SEQ ID NO: 1077 - DNA, 200 bp, Conyza canadensis
ttgatctgcctttgacgacgactttttcctcttcctttgggcgtcgggtagtaatgctgcggttatccgcatatttataattaggatcgaaaagcacatggagatgtaaattaaagagagacaggaacgagggtttcttacttgggcagatatcgatgtggatggaaagcaaattcgaaaacccaaaattcgatcaaagt

SEQ ID NO: 1078 - DNA, 200 bp, Conyza canadensis
aaagtcgtcgtcaaaggcagatcaacaaatattgatatattgataataatgtaatagaatatgagaggcttccagccaagtccgcatgtcgtttcaagtctgtttccaaacactggaattcgttcctatccacacgtatgtttggaccaccagctccatcacatgaacaaatcctataaacttctcttacttgaccagct

SEQ ID NO: 1079 - DNA, 200 bp, Conyza canadensis
agctggtcaagtaagagaagtttataggatttgttcatgtgatggagctggtggtccaaacatacgtgtggataggaacgaattccagtgtttggaaacagacttgaaacgacatgcggacttggctggaagcctctcatattctattacattattatcaatatatcaatatttgttgatctgcctttgacgacgacttt

SEQ ID NO: 1080 - DNA, 200 bp, Conyza canadensis
ataaacttctcttacttgaccagctagccccctgtagataaggatttatgcagcaaacccctcaaccacgtacggttccattaccgtcggttttaatcgactggaggaagccgatcctagatttaattcgcttgtaggatggattggtatgtgtagccgatccttgatctatatttcaatttcactggctaggtgtaggc

SEQ ID NO: 1081 - DNA, 200 bp, Conyza canadensis
gcctacacctagccagtgaaattgaaatatagatcaaggatcggctacacataccaatccatcctacaagcgaattaaatctaggatcggcttcctccagtcgattaaaaccgacggtaatggaaccgtacgtggttgaggggtttgctgcataaatccttatctacagggggctagctggtcaagtaagagaagtttat

SEQ ID NO: 1082 - DNA, 200 bp, Conyza canadensis
tcaatttcactggctaggtgtaggcattattattaagcaatgtgatcgattgatggctaattcaggcgtttgaattcaacttttcattagtcaagtaattattctcaagtttatatattaatagtatatatacgatatcatagtataatatacaaaataaaatctatccaaaaggaataaaatctttggaaaggaataaa

SEQ ID NO: 1083 - DNA, 200 bp, Conyza canadensis
tttattcctttccaaagattttattccttttggatagattttattttgtatattatactatgatatcgtatatatactattaatatataaacttgagaataattacttgactaatgaaaagttgaattcaaacgcctgaattagccatcaatcgatcacattgcttaataataatgcctacacctagccagtgaaattga

SEQ ID NO: 1084 - DNA, 200 bp, Conyza canadensis
aataaaatctttggaaaggaataaaatctatccaaaaagaataaaatctatccaaaaggaataaaatctttctaaagatttcggacattcactataaatagtgacagcagatgagatggaaagaaaaaaagaaaaaaaggaacaagaatactcctttggagagaatacttgaactctcatccctcaaatcattgttaaca

SEQ ID NO: 1085 - DNA, 200 bp, Conyza canadensis
tgttaacaatgatttgagggatgagagttcaagtattctctccaaaggagtattcttgttcctttttttctttttttctttccatctcatctgctgtcactatttatagtgaatgtccgaaatctttagaaagattttattccttttggatagattttattctttttggatagattttattcctttccaaagattttatt

SEQ ID NO: 1086 - DNA, 200 bp, Conyza canadensis
ctcatccctcaaatcattgttaacataatcactaccctcataggattggatggcgtaaaaccgtatacgtaatacggttaccagcagggatcgccacccaaatatcctaatcttcctcacaccttcccatgctaggtggcatgggacccacataactctctttatttatataatgatattagattacatactccttgaac

SEQ ID NO: 1087 - DNA, 200 bp, Conyza canadensis
gttcaaggagtatgtaatctaatatcattatataaataaagagagttatgtgggtcccatgccacctagcatgggaaggtgtgaggaagattaggatatttgggtggcgatccctgctggtaaccgtattacgtatacggttttacgccatccaatcctatgagggtagtgattatgttaacaatgatttgagggatgag

SEQ ID NO: 1088 - DNA, 200 bp, Conyza canadensis
atattagattacatactccttgaaccgtaagtgttaatcgacgtatcatcatatatacactaatatctatgttaaataattaataaacaaaatatgacacataaaatttttgcgagatatttttggcgaagcattgcacaaaaagcagcaaggctaggatatttttggcccacaatgtaccgcgatgcaacaaagattgt

SEQ ID NO: 1089 - DNA, 200 bp, Conyza canadensis
acaatctttgttgcatcgcggtacattgtgggccaaaaatatcctagccttgctgctttttgtgcaatgcttcgccaaaaatatctcgcaaaaattttatgtgtcatattttgtttattaattatttaacatagatattagtgtatatatgatgatacgtcgattaacacttacggttcaaggagtatgtaatctaatat

SEQ ID NO: 1090 - DNA, 200 bp, Conyza canadensis
tgtaccgcgatgcaacaaagattgtcgacaattgtgataattgccaatgccatgctcctatcatacgtcaaccccaacacgacttgacaagtatttcaagtccatggccgttctatcaatggggaacagatatcgtaggaccattcccagaagcaccaggaaaagtgaaatttttggtagtcgcaatcgactattttact

SEQ ID NO: 1091 - DNA, 200 bp, Conyza canadensis
agtaaaatagtcgattgcgactaccaaaaatttcacttttcctggtgcttctgggaatggtcctacgatatctgttccccattgatagaacggccatggacttgaaatacttgtcaagtcgtgttggggttgacgtatgataggagcatggcattggcaattatcacaattgtcgacaatctttgttgcatcgcggtaca

SEQ ID NO: 1092 - DNA, 200 bp, Conyza canadensis
ggtagtcgcaatcgactattttactaaattggcagaagcagagccactggcaacaataactggacataaaatactcaagttcgtatggcgcaacattgtatgtcgttatggaattccaggaattatcatcagtgacaacggaaagcaattcgcaaataacccatttcgggagtggtgtgaagagcttaaaataagacaac

SEQ ID NO: 1093 - DNA, 200 bp, Conyza canadensis
gttgtcttattttaagctcttcacaccactcccgaaatgggttatttgcgaattgctttccgttgtcactgatgataattcctggaattccataacgacatacaatgttgcgccatacgaacttgagtattttatgtccagttattgttgccagtggctctgcttctgccaatttagtaaaatagtcgattgcgactacc

SEQ ID NO: 1094 - DNA, 200 bp, Conyza canadensis
ttaggtggaatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttgatgctgtgatcatgactgccccact

SEQ ID NO: 1095 - DNA, 200 bp, Conyza canadensis
agtggggcagtcatgatcacagcatcaaaaggttgctgatttaattgtttgttctgatctggagcacaatagatcgaccaattcccagtagtgttatcatcacagctataggacatttcaagcaccttggattgaagattaagttcatgttgtccaacttctttgctcagtgcatttgtaagtgtctgcattccacctaa

SEQ ID NO: 1096 - DNA, 200 bp, Conyza canadensis
atgctgtgatcatgactgccccacttggcaatgtgaaagaaatgaagattacaaagacaggaagtctgttcctgctcaattttatacctgagcttagttatatgccagtttcagtcataatctctacattcaagaaagagaatgtgaagcggccccttgagggatttggaatgcttgttcctgccaaggagcaggaaaat

SEQ ID NO: 1097 - DNA, 200 bp, Conyza canadensis
attttcctgctccttggcaggaacaagcattccaaatccctcaaggggccgcttcacattctctttcttgaatgtagagattatgactgaaactggcatataactaagctcaggtataaaattgagcaggaacagacttcctgtctttgtaatcttcatttctttcacattgccaagtggggcagtcatgatcacagcat

SEQ ID NO: 1098 - DNA, 200 bp, Conyza canadensis
tgttcctgccaaggagcaggaaaatggtttgaagacgttaggcactctcttttcttccatgatgtttccagatcgtgcccctgaagacttgtatctttataccacctttgttgggggaagtcgaaacaaagaactggccaatgcttcgagggatgagttgaagcagatagtaacttctgacctcagacagttgcttggag

SEQ ID NO: 1099 - DNA, 200 bp, Conyza canadensis
ctccaagcaactgtctgaggtcagaagttactatctgcttcaactcatccctcgaagcattggccagttctttgtttcgacttcccccaacaaaggtggtataaagatacaagtcttcaggggcacgatctggaaacatcatggaagaaaagagagtgcctaacgtcttcaaaccattttcctgctccttggcaggaaca

SEQ ID NO: 1100 - DNA, 200 bp, Digitaria sanguinalis
acctaatgccatctcaaaaagcttgggtagcagagtgaaattatcatggaagctaataaatatctcaaagttggagaatagaggttataatttgacttacgaaacaccaaatggatttgcaagtctgcaaactaaaactgttgtcatgactgttccttcctacgtggcgagtgacttgttgcgtcctctttcgtcggaag

SEQ ID NO: 1101 - DNA, 200 bp, Digitaria sanguinalis
cttccgacgaaagaggacgcaacaagtcactcgccacgtaggaaggaacagtcatgacaacagttttagtttgcagacttgcaaatccatttggtgtttcgtaagtcaaattataacctctattctccaactttgagatatttattagcttccatgataatttcactctgctacccaagctttttgagatggcattaggt

SEQ ID NO: 1102 - DNA, 200 bp, Digitaria sanguinalis
ttgttgcgtcctctttcgtcggaagcagctgaggctttgtccaaattttattaccctccagttgcagctgtatctgtttcctatccaaaagaggcgattcgtgctgaccgtttgatcgatggtcaacttaagggttttggtcaattacatccaagaagtcaaggcgttgagactttaggtaccatctatagttcatccct

SEQ ID NO: 1103 - DNA, 200 bp, Digitaria sanguinalis
agggatgaactatagatggtacctaaagtctcaacgccttgacttcttggatgtaattgaccaaaacccttaagttgaccatcgatcaaacggtcagcacgaatcgcctcttttggataggaaacagatacagctgcaactggagggtaataaaatttggacaaagcctcagctgcttccgacgaaagaggacgcaacaa

SEQ ID NO: 1104 - DNA, 200 bp, Digitaria sanguinalis
cttgcgtctcacaaaaggcgcgagctggccggcccgctacttttgtgctttgtcttgtctccttcaggcttcagcaatggacaaacatccccctcaagtaaagcttaatagaaatcgattttgatgaacgaataaccatcattaacggcatcatggccatcgcttcgatgggatcagttgcttgcagagccggccaaagt

SEQ ID NO: 1105 - DNA, 200 bp, Digitaria sanguinalis
actttggccggctctgcaagcaactgatcccatcgaagcgatggccatgatgccgttaatgatggttattcgttcatcaaaatcgatttctattaagctttacttgagggggatgtttgtccattgctgaagcctgaaggagacaagacaaagcacaaaagtagcgggccggccagctcgcgccttttgtgagacgcaag

SEQ ID NO: 1106 - DNA, 200 bp, Digitaria sanguinalis
agttgcttgcagagccggccaaagtgggcacgtgagagccacgaggatacgcgagatgacgacgaccatggaggtggtttcgaactttcgatcgccgatttttattgcgtcagtttcacagccagagatgcttggcctagtacggctgacgatgagcgtttgtttagctcatctgaaggaatgtgttttgcctgttgcca

SEQ ID NO: 1107 - DNA, 200 bp, Digitaria sanguinalis
tggcaacaggcaaaacacattccttcagatgagctaaacaaacgctcatcgtcagccgtactaggccaagcatctctggctgtgaaactgacgcaataaaaatcggcgatcgaaagttcgaaaccacctccatggtcgtcgtcatctcgcgtatcctcgtggctctcacgtgcccactttggccggctctgcaagcaact

SEQ ID NO: 1108 - DNA, 200 bp, Digitaria sanguinalis
aaggaatgtgttttgcctgttgccaccaagattagcgtccttttcttttatcgaattcgggtcaccatttccactattaatcaaagatatagtttctatattttttctcattaatccacagtaccttttatttcagtagttattattgcatccatacttcaccagtacggcaccctttgcaatctctgcctacactccat

SEQ ID NO: 1109 - DNA, 200 bp, Digitaria sanguinalis
atggagtgtaggcagagattgcaaagggtgccgtactggtgaagtatggatgcaataataactactgaaataaaaggtactgtggattaatgagaaaaaatatagaaactatatctttgattaatagtggaaatggtgacccgaattcgataaaagaaaaggacgctaatcttggtggcaacaggcaaaacacattcctt

SEQ ID NO: 1110 - DNA, 200 bp, Digitaria sanguinalis
tttgcaatctctgcctacactccattacctcgaagaatagtgcactacagatgcaataaacacccacctcaccgactgctcgtaggtgcaccagtacactacatttgctgctgcatgctggtcgccatcatccttcctgcctgcaggaagcagcagggtgtctgggatctgcatcatgccgggcgcacaagaggaacaga

SEQ ID NO: 1111 - DNA, 200 bp, Digitaria sanguinalis
tctgttcctcttgtgcgcccggcatgatgcagatcccagacaccctgctgcttcctgcaggcaggaaggatgatggcgaccagcatgcagcagcaaatgtagtgtactggtgcacctacgagcagtcggtgaggtgggtgtttattgcatctgtagtgcactattcttcgaggtaatggagtgtaggcagagattgcaaa

SEQ ID NO: 1112 - DNA, 200 bp, Digitaria sanguinalis
atgccgggcgcacaagaggaacagacgtgccaataaaagggctagcaacgcaacgaggggagggcccctttttttcgtgttacctcccgtcctgtgcatgagttgtcgtgtgtaacagacgtgcttggtgataaagcgtaggtgaagaagtggcctcccctgtgtcccctcccttctcaggaacgtttcgtcatcttttc

SEQ ID NO: 1113 - DNA, 200 bp, Digitaria sanguinalis
gaaaagatgacgaaacgttcctgagaagggaggggacacaggggaggccacttcttcacctacgctttatcaccaagcacgtctgttacacacgacaactcatgcacaggacgggaggtaacacgaaaaaaaggggccctcccctcgttgcgttgctagcccttttattggcacgtctgttcctcttgtgcgcccggcat

SEQ ID NO: 1114 - DNA, 200 bp, Digitaria sanguinalis
ctcaggaacgtttcgtcatcttttcactgaaaacgggcgcgtgctaactgccgcatctgtgagttgaatggttgattggagagaaattaggtgtgcaatcaccacttgggcggcaatcgtgtgcacttacttttggttgggtgtcagatcaacaacaggggtttcttggggaaatgtttccaaatgtacttctcaaaatt

SEQ ID NO: 1115 - DNA, 200 bp, Digitaria sanguinalis
aattttgagaagtacatttggaaacatttccccaagaaacccctgttgttgatctgacacccaaccaaaagtaagtgcacacgattgccgcccaagtggtgattgcacacctaatttctctccaatcaaccattcaactcacagatgcggcagttagcacgcgcccgttttcagtgaaaagatgacgaaacgttcctgag

SEQ ID NO: 1116 - DNA, 200 bp, Digitaria sanguinalis
gtttccaaatgtacttctcaaaattacttctagtgtacacatgttgaatttcagttcaaatttatttacaagaataataaacaaagaagaaaattggcaaacaacattcataaaaaatggaatgaaaagagaaatgcatccttcttttgaagataaatagtcaaatgccatgtttgtttcgttcacaaacagaaaaatga

SEQ ID NO: 1117 - DNA, 200 bp, Digitaria sanguinalis
tcatttttctgtttgtgaacgaaacaaacatggcatttgactatttatcttcaaaagaaggatgcatttctcttttcattccattttttatgaatgttgtttgccaattttcttctttgtttattattcttgtaaataaatttgaactgaaattcaacatgtgtacactagaagtaattttgagaagtacatttggaaac

SEQ ID NO: 1118 - DNA, 200 bp, Digitaria sanguinalis
gtttcgttcacaaacagaaaaatgatttcatgattgcaccgcaagagtggatgaatatatataggtctacagttgaacaccaatttggaagaaaaattcatgaggcagaagtaaaatcgattatttccttgagcttccgcattgcatctcccaaaagaaaaccattaaatactactagcaagttctagtacagtccctac

SEQ ID NO: 1119 - DNA, 200 bp, Digitaria sanguinalis
gtagggactgtactagaacttgctagtagtatttaatggttttcttttgggagatgcaatgcggaagctcaaggaaataatcgattttacttctgcctcatgaatttttcttccaaattggtgttcaactgtagacctatatatattcatccactcttgcggtgcaatcatgaaatcatttttctgtttgtgaacgaaac

SEQ ID NO: 1120 - DNA, 200 bp, Digitaria sanguinalis
tagcaagttctagtacagtccctactaattaaacatcagcataattatccttcttatactcactcgggttttttcttatatgtcgtattagtttcatcttaagtcaaacttgtcaaaatttgaccaagtttatacaaaagtataacaataactatactaccaaacttatatggtatcacaatatatttcattagtaggga

SEQ ID NO: 1121 - DNA, 200 bp, Digitaria sanguinalis
tccctactaatgaaatatattgtgataccatataagtttggtagtatagttattgttatacttttgtataaacttggtcaaattttgacaagtttgacttaagatgaaactaatacgacatataagaaaaaacccgagtgagtataagaaggataattatgctgatgtttaattagtagggactgtactagaacttgcta

SEQ ID NO: 1122 - DNA, 200 bp, Digitaria sanguinalis
tcacaatatatttcattagtagggactgtctcgccggtcggggaaattaaacgccccccgatccgtcaccgtgacctgccctcctccccgcccgggcagatcgggccatcgcctccatcggggcacggctaggtacctgaaaacgatcgagcaaagcggccggttcgtttcgttcgtagcgagaggcatttgctgccagt

SEQ ID NO: 1123 - DNA, 200 bp, Digitaria sanguinalis
actggcagcaaatgcctctcgctacgaacgaaacgaaccggccgctttgctcgatcgttttcaggtacctagccgtgccccgatggaggcgatggcccgatctgcccgggcggggaggagggcaggtcacggtgacggatcggggggcgtttaatttccccgaccggcgagacagtccctactaatgaaatatattgtga

SEQ ID NO: 1124 - DNA, 200 bp, Digitaria sanguinalis
gtagcgagaggcatttgctgccagttcccggcgcgggacacgcgcgcgcgaaatggcggtgtcgagagggagggaggcgtcgctttcggcgggcgggggcgtgttccctggctgtagcccggcggcgcggcaggcctcgcgcgggtgtcaataccggcccggcggattaggtccccgtctttatgaccggcgcgcgcgca

SEQ ID NO: 1125 - DNA, 200 bp, Digitaria sanguinalis
tgcgcgcgcgccggtcataaagacggggacctaatccgccgggccggtattgacacccgcgcgaggcctgccgcgccgccgggctacagccagggaacacgcccccgcccgccgaaagcgacgcctccctccctctcgacaccgccatttcgcgcgcgcgtgtcccgcgccgggaactggcagcaaatgcctctcgctac

SEQ ID NO: 1126 - DNA, 200 bp, Digitaria sanguinalis
cgtctttatgaccggcgcgcgcgcacccttgcggtgcccgtgcgttgacgacgctgccaccgcacgtcccccttcttcattccatggcagggacgacgacgctagctatagctgcacgtacgcggtcgatcgagtggctatggcttggtctctactgcacgccatgccgcccggcctcccaccacaataactcgtgtgcc

SEQ ID NO: 1127 - DNA, 200 bp, Digitaria sanguinalis
ggcacacgagttattgtggtgggaggccgggcggcatggcgtgcagtagagaccaagccatagccactcgatcgaccgcgtacgtgcagctatagctagcgtcgtcgtccctgccatggaatgaagaagggggacgtgcggtggcagcgtcgtcaacgcacgggcaccgcaagggtgcgcgcgcgccggtcataaagacg

SEQ ID NO: 1128 - DNA, 200 bp, Digitaria sanguinalis
ctcccaccacaataactcgtgtgccggcccggcacggcgcgggccgtggtggaactgatcgcgtcgcgcattgatcatcatgcgtgggggcgtcggggcgacggctcgagcgtgcgcacatgattgtgcgtgtcaggatcccagacgctagctacagcttgctgctggtccatccagtgccctacgtggacgccgatcgc

SEQ ID NO: 1129 - DNA, 200 bp, Digitaria sanguinalis
gcgatcggcgtccacgtagggcactggatggaccagcagcaagctgtagctagcgtctgggatcctgacacgcacaatcatgtgcgcacgctcgagccgtcgccccgacgcccccacgcatgatgatcaatgcgcgacgcgatcagttccaccacggcccgcgccgtgccgggccggcacacgagttattgtggtgggag

SEQ ID NO: 1130 - DNA, 200 bp, Digitaria sanguinalis
agtgccctacgtggacgccgatcgctgtgtgttggtgtgtggggtgatgatgatggcggatggatggagtcatggaggcactgcggggctcacaggagattttggtgggtggtggacgcatccgtcgcgtcgcccccggcgctcgagtgcaccccgtaccaacccaacacgtccgctgtcgtggagacgccggagggcgc

SEQ ID NO: 1131 - DNA, 200 bp, Digitaria sanguinalis
gcgccctccggcgtctccacgacagcggacgtgttgggttggtacggggtgcactcgagcgccgggggcgacgcgacggatgcgtccaccacccaccaaaatctcctgtgagccccgcagtgcctccatgactccatccatccgccatcatcatcaccccacacaccaacacacagcgatcggcgtccacgtagggcact

SEQ ID NO: 1132 - DNA, 200 bp, Digitaria sanguinalis
ctgtcgtggagacgccggagggcgcatgaaatcattgttaattttctcttgtgtgttttttttaaaaaaattataataacaaaagatgcatgctcccttcttctttgattaactaatcgatcagctagctaactcacacattgtccttcctgcaagtagcgcatgtatatttatgctcaactatatgggtatatactttt

SEQ ID NO: 1133 - DNA, 200 bp, Digitaria sanguinalis
aaaagtatatacccatatagttgagcataaatatacatgcgctacttgcaggaaggacaatgtgtgagttagctagctgatcgattagttaatcaaagaagaagggagcatgcatcttttgttattataatttttttaaaaaaaacacacaagagaaaattaacaatgatttcatgcgccctccggcgtctccacgacag

SEQ ID NO: 1134 - DNA, 200 bp, Digitaria sanguinalis
gacatcctgcgtccactttcaagtgatgctgcagatgccctttcaagattctattatccaccagttggtgctgtgactatttcatatccaaaggaagcaattagaaaggaatgcttgattgatggggagctccagggttttggccagttgcatccacgtagtcaaggagttgagacattaggaacaatatacagctcatc

SEQ ID NO: 1135 - DNA, 200 bp, Digitaria sanguinalis
gatgagctgtatattgttcctaatgtctcaactccttgactacgtggatgcaactggccaaaaccctggagctccccatcaatcaagcattcctttctaattgcttcctttggatatgaaatagtcacagcaccaactggtggataatagaatcttgaaagggcatctgcagcatcacttgaaagtggacgcaggatgtc

SEQ ID NO: 1136 - DNA, 200 bp, Digitaria sanguinalis
cattaggaacaatatacagctcatcactcttcccaaatcgtgctcctgctggaagggtattacttctaaactatataggaggtgctacaaacactgggattgtctccaagagtgaaagtgagctggtagaagcagttgaccgtgaccttaggaaaatgctcatcaaccctagagcagtggaccctttagtccttggtgtc

SEQ ID NO: 1137 - DNA, 200 bp, Digitaria sanguinalis
gacaccaaggactaaagggtccactgctctagggttgatgagcattttcctaaggtcacggtcaactgcttctaccagctcactttcactcttggagacaatcccagtgtttgtagcacctcctatatagtttagaagtaatacccttccagcaggagcacgatttgggaagagtgatgagctgtatattgttcctaatg

SEQ ID NO: 1138 - DNA, 200 bp, Digitaria sanguinalis
agtggaccctttagtccttggtgtccgagtgtggccacaagccatacctcagttcctggtaggacatcttgatcttctggaggttgcaaaatctgccttgggccgaggtggctatgatgggctcttcctaggagggaattatgtagcaggagttgccctgggccgatgcgtggagggtgcctatgaaagcgcctcgcaaa

SEQ ID NO: 1139 - DNA, 200 bp, Digitaria sanguinalis
tttgcgaggcgctttcataggcaccctccacgcatcggcccagggcaactcctgctacataattccctcctaggaagagcccatcatagccacctcggcccaaggcagattttgcaacctccagaagatcaagatgtcctaccaggaactgaggtatggcttgtggccacactcggacaccaaggactaaagggtccact

SEQ ID NO: 1140 - DNA, 200 bp, Digitaria sanguinalis
ggtgcctatgaaagcgcctcgcaaatatctgacttcttgaccaagtatgcctacaagtgatgaaagaagtcgagctgctcgttgttttgcatagatgaggtgagaccaggagtggcacaaagtttacaaggattttttttttcatcttatttcgtaaattgtacttctgatctttttccctgttagtaattagttagact

SEQ ID NO: 1141 - DNA, 200 bp, Digitaria sanguinalis
agtctaactaattactaacagggaaaaagatcagaagtacaatttacgaaataagatgaaaaaaaaaatccttgtaaactttgtgccactcctggtctcacctcatctatgcaaaacaacgagcagctcgacttctttcatcacttgtaggcatacttggtcaagaagtcagatatttgcgaggcgctttcataggcacc

SEQ ID NO: 1142 - DNA, 200 bp, Digitaria sanguinalis
taggtatttctttcaactgagtcttaagctacaacatctacagattattgtttttcttttgtggtgtgatttttcattctagtatgtattatgtcttcttttgttgaatccaagatatgaatcaaaatagtggtggtatgcttttgtaggaacaatatacagctcatcactcttcccaaatcgtgctcctgctggaaggg

SEQ ID NO: 1143 - DNA, 200 bp, Digitaria sanguinalis
cccttccagcaggagcacgatttgggaagagtgatgagctgtatattgttcctacaaaagcataccaccactattttgattcatatcttggattcaacaaaagaagacataatacatactagaatgaaaaatcacaccacaaaagaaaaacaataatctgtagatgttgtagcttaagactcagttgaaagaaataccta

SEQ ID NO: 1144 - DNA, 200 bp, Digitaria sanguinalis
ccaaatcgtgctcctgctggaagggtgttacttctaaactatataggaggtgctacaaacactggaattgtttccaaggttagtaattctctgtcgaacttattgccttgagttttgtgttcatgatgttttgactgtaaaaagaaaattggcattctttaataatcaacgtaagcagtattttaaaaagaaagttggca

SEQ ID NO: 1145 - DNA, 200 bp, Digitaria sanguinalis
tgccaactttctttttaaaatactgcttacgttgattattaaagaatgccaattttctttttacagtcaaaacatcatgaacacaaaactcaaggcaataagttcgacagagaattactaaccttggaaacaattccagtgtttgtagcacctcctatatagtttagaagtaacacccttccagcaggagcacgatttgg

SEQ ID NO: 1146 - DNA, 200 bp, Digitaria sanguinalis
cagtattttaaaaagaaagttggcattttaataatcaatatcaacttgtaactagattgcttattattggctattattatttaggtgggacccgcagactatttaggtgtggaacccatgtgggacccgcatactatttaggcgggacccacgcatattcagacacactatttagagtggaacctacaataatgttaagc

SEQ ID NO: 1147 - DNA, 200 bp, Digitaria sanguinalis
gcttaacattattgtaggttccactctaaatagtgtgtctgaatatgcgtgggtcccgcctaaatagtatgcgggtcccacatgggttccacacctaaatagtctgcgggtcccacctaaataataatagccaataataagcaatctagttacaagttgatattgattattaaaatgccaactttctttttaaaatactg

SEQ ID NO: 1148 - DNA, 200 bp, Digitaria sanguinalis
agtggaacctacaataatgttaagcgtctacgttatttaaaaaattattgataattgttttcattctttgcagtataaaatatatttatttttttctatgtataaaaataatctctaactttgtatactacattcgtttgtgatagttctaatactttttgtactttgctttcatttcataaatttgaaaaataagattg

SEQ ID NO: 1149 - DNA, 200 bp, Digitaria sanguinalis
caatcttatttttcaaatttatgaaatgaaagcaaagtacaaaaagtattagaactatcacaaacgaatgtagtatacaaagttagagattatttttatacatagaaaaaaataaatatattttatactgcaaagaatgaaaacaattatcaataattttttaaataacgtagacgcttaacattattgtaggttccact

SEQ ID NO: 1150 - DNA, 200 bp, Digitaria sanguinalis
ttcataaatttgaaaaataagattgaattatacattcgttacaaaatgtatcttttttctattaaaaattaaaaattagtgtaacataacacgtcactccattagctatttctactaccacttatatagtgcttaaatgattattatgattaaaaaatttgtctaaatttaatattgcattgagtatagtaagataacaa

SEQ ID NO: 1151 - DNA, 200 bp, Digitaria sanguinalis
ttgttatcttactatactcaatgcaatattaaatttagacaaattttttaatcataataatcatttaagcactatataagtggtagtagaaatagctaatggagtgacgtgttatgttacactaatttttaatttttaatagaaaaaagatacattttgtaacgaatgtataattcaatcttatttttcaaatttatgaa

SEQ ID NO: 1152 - DNA, 200 bp, Digitaria sanguinalis
tgcattgagtatagtaagataacaaatttgtattacatcattattttagtttaacatcttctatatagacgcacatcgctcgtcaacccaactagtattcctaatgatgccatctcaattgcagagtgaaagtgagctggtagaagcagttgatcgtgacctcaggaaaatgctcatcgaccctagagcagtggaccctt

SEQ ID NO: 1153 - DNA, 200 bp, Digitaria sanguinalis
aagggtccactgctctagggtcgatgagcattttcctgaggtcacgatcaactgcttctaccagctcactttcactctgcaattgagatggcatcattaggaatactagttgggttgacgagcgatgtgcgtctatatagaagatgttaaactaaaataatgatgtaatacaaatttgttatcttactatactcaatgca

SEQ ID NO: 1154 - DNA, 200 bp, Digitaria sanguinalis
tggaggattctttcaacgtcattttgggaaggaggttgttgagtatctcattgatccagttgttgcgggaacaagcggtggagatcctgaatcactttcaatgcgttatgcgtttcctgagttatgggatttagagagaaggttcggttcaatcatttctggggcatttctgtcaatgttatcttccagaggtgggaaaa

SEQ ID NO: 1155 - DNA, 200 bp, Digitaria sanguinalis
ttttcccacctctggaagataacattgacagaaatgccccagaaatgattgaaccgaaccttctctctaaatcccataactcaggaaacgcataacgcattgaaagtgattcaggatctccaccgcttgttcccgcaacaactggatcaatgagatactcaacaacctccttcccaaaatgacgttgaaagaatcctcca

SEQ ID NO: 1156 - DNA, 200 bp, Digitaria sanguinalis
atgttatcttccagaggtgggaaaaggaaaccttctggaaacagcaaacgtaggcgtggttctttttcttttttgggtgggatgcagacgctcactgatgcactatgcaaagagattggaccccatgaatttaatctccaatcaaaggttcttgaaatgtcctacagctgcgatgataacgtggttggtaattggtcaat

SEQ ID NO: 1157 - DNA, 200 bp, Digitaria sanguinalis
attgaccaattaccaaccacgttatcatcgcagctgtaggacatttcaagaacctttgattggagattaaattcatggggtccaatctctttgcatagtgcatcagtgagcgtctgcatcccacccaaaaaagaaaaagaaccacgcctacgtttgctgtttccagaaggtttccttttcccacctctggaagataacat

SEQ ID NO: 1158 - DNA, 121 bp, Euphorbia heterophylla; identical to SEQ ID NO: 47

SEQ ID NO: 1159 - DNA, 121 bp, Euphorbia heterophylla
aaatttaaaaatttattagtgtaaaatatgggtgtgcaaatggttttggtaaccgcatttccgaatcgaatcagactgagttattaatttggtttggttactctgaaaattcggttcggtt

SEQ ID NO: 1160 - DNA, 200 bp, Euphorbia heterophylla
acaggttgtgcattccacccagaaacgtcagcgtggttcattttcgtttctgggtggaatgcagactcttcctgacaggttgtgcaaagagcttgcaaaagacgagcttagacttgagtcaaaggttttgtctttgtcttataatcacgattctagatcggcgttagacaattggtctgtctcttttgcttctaagggca

SEQ ID NO: 1161 - DNA, 200 bp, Euphorbia heterophylla
tgcccttagaagcaaaagagacagaccaattgtctaacgccgatctagaatcgtgattataagacaaagacaaaacctttgactcaagtctaagctcgtcttttgcaagctctttgcacaacctgtcaggaagagtctgcattccacccagaaacgaaaatgaaccacgctgacgtttctgggtggaatgcacaacctgt

SEQ ID NO: 1162 - DNA, 200 bp, Euphorbia heterophylla
tctgtctcttttgcttctaagggcaacaaacgtatgcaagactcgtcatatgatgccgtcattatgacggcaccactttgcaacctcaaagaaatgaggatcacaaaaggcagaaatcacttcctgttggactttattcccgaggtaatttatatgccactgtcggtcattattacgacgttcaagaaggagaatgtcaa

SEQ ID NO: 1163 - DNA, 200 bp, Euphorbia heterophylla
ttgacattctccttcttgaacgtcgtaataatgaccgacagtggcatataaattacctcgggaataaagtccaacaggaagtgatttctgccttttgtgatcctcatttctttgaggttgcaaagtggtgccgtcataatgacggcatcatatgacgagtcttgcatacgtttgttgcccttagaagcaaaagagacaga

SEQ ID NO: 1164 - DNA, 200 bp, Euphorbia heterophylla
acttttttacatgttcagggggttatttgaaacatttgaaagttcaaggggtaactagccctttttgaacaagttcaggggttttcatgtattaggcctctatttaatattggatgctccaattggacacctgagctttatgttgtcataattagtagtagatatagctttcttttaattttcacgtgtttttttcgtgt

SEQ ID NO: 1165 - DNA, 200 bp, Euphorbia heterophylla
acacgaaaaaaacacgtgaaaattaaaagaaagctatatctactactaattatgacaacataaagctcaggtgtccaattggagcatccaatattaaatagaggcctaatacatgaaaacccctgaacttgttcaaaaagggctagttaccccttgaactttcaaatgtttcaaataaccccctgaacatgtaaaaaagt

SEQ ID NO: 1166 - DNA, 200 bp, Euphorbia heterophylla
taattttcacgtgtttttttcgtgtaaatagaaagacagcgaacttgttgaagcagttgaccgtgatctgcgaaagatgctcataaatcccaatgcaaaggatccacttacacttggcgtaagagtgtggcctcaagccattccacagtttctgattggtcactacgatatcctagatacggcgaaaaatgcgttaagtg

SEQ ID NO: 1167 - DNA, 200 bp, Euphorbia heterophylla
cacttaacgcatttttcgccgtatctaggatatcgtagtgaccaatcagaaactgtggaatggcttgaggccacactcttacgccaagtgtaagtggatcctttgcattgggatttatgagcatctttcgcagatcacggtcaactgcttcaacaagttcgctgtctttctatttacacgaaaaaaacacgtgaaaatta

SEQ ID NO: 1168 - DNA, 200 bp, Euphorbia heterophylla
gatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaacccagtatacttataaatagtatctgatgagatttaagcaagagttcaattatgctgcggctaa

SEQ ID NO: 1169 - DNA, 200 bp, Euphorbia heterophylla
ttagccgcagcataattgaactcttgcttaaatctcatcagatactatttataagtatactgggttaggaaattagtaacactggacgcagtttcatatgctccttcaacacattttcccaaagctacaccatacacatagttaccccctaaaaacagcccttccaagccttgttcacttaacgcatttttcgccgtatc

SEQ ID NO: 1170 - DNA, 200 bp, Euphorbia heterophylla
aagagttcaattatgctgcggctaagtactgtgagtttattgagtagtgggtaaaaatgttgctttaggtctgttgtatttgtaatagttgcttcacgtttttcattaaggatggtgtattctctagttatgcattcttgttcatttagcaggcaaaacgagtttgatgtgcattcagaatatgttggcagttgattgac

SEQ ID NO: 1171 - DNA, 200 bp, Euphorbia heterophylla
gtcaatcaactgccaacatattctgaatgcacatcaaactcgttttgcctgctaaatgaacaagaatgcataactagagaatacaccatccttaatgaaaaacgtgaagcaactattacaaatacaacagacctaaagcaacatttttacccactactcaataaactcacagtacttagccgcagcataattgaactctt

SEQ ID NO: 1172 - DNA, 200 bp, Euphorbia heterophylla
agattagtgaatgatcacaacaaataccgtttgataagtccaattttttctttttttgcaagatttggttctattatagctggggcaattcagtcaaatttttcctcgaaaaaggataagagcaaggagacaaattcatcaagacataagaaacgtcagcgtggttcattttcgtttctgggtggaatgcaggtattaga

SEQ ID NO: 1173 - DNA, 200 bp, Euphorbia heterophylla
tctaatacctgcattccacccagaaacgaaaatgaaccacgctgacgtttcttatgtcttgatgaatttgtctccttgctcttatcctttttcgaggaaaaatttgactgaattgccccagctataatagaaccaaatcttgcaaaaaaagaaaaaattggacttatcaaacggtatttgttgtgatcattcactaatct

SEQ ID NO: 1174 - DNA, 200 bp, Euphorbia heterophylla
ttctgggtggaatgcaggtattagatgtaggatattacttatgaactctgaaatttgtatctaatatcacttttcttaaagcccctaaatgattttaatattaggattttctttttgtatctagctttattatttgctcgattttactcgttaaagctatgtttatttgttgagaagccttctagaggcgatacagattt

SEQ ID NO: 1175 - DNA, 200 bp, Euphorbia heterophylla
aaatctgtatcgcctctagaaggcttctcaacaaataaacatagctttaacgagtaaaatcgagcaaataataaagctagatacaaaaagaaaatcctaatattaaaatcatttaggggctttaagaaaagtgatattagatacaaatttcagagttcataagtaatatcctacatctaatacctgcattccacccagaa

SEQ ID NO: 1176 - DNA, 200 bp, Euphorbia heterophylla
agccttctagaggcgatacagattttcttagcttatgcaagtgattatcctatgaactatttatgttttcttttcccgaatctatttttctttgcagactcttcctgacaggttgtgcaaagagcttgctaaagacgagcttagacttgggtcaaaggttttgtctttgtcttataatcacgattctagatcggcgttag

SEQ ID NO: 1177 - DNA, 200 bp, Euphorbia heterophylla
ctaacgccgatctagaatcgtgattataagacaaagacaaaacctttgacccaagtctaagctcgtctttagcaagctctttgcacaacctgtcaggaagagtctgcaaagaaaaatagattcgggaaaagaaaacataaatagttcataggataatcacttgcataagctaagaaaatctgtatcgcctctagaaggct

SEQ ID NO: 1178 - DNA, 200 bp, Euphorbia heterophylla
aatcacgattctagatcggcgttagacaattggtctgtctcttttgcttctaagggcgacaaacgtatgcaaaactcgtcatatgatgctgtcattatgacggttagcaacttctttactgatgatataatgtttatcaattaatctttttgatatcgaaacgaaacaatttcattgtttactcagattcattatcactt

SEQ ID NO: 1179 - DNA, 200 bp, Euphorbia heterophylla
aagtgataatgaatctgagtaaacaatgaaattgtttcgtttcgatatcaaaaagattaattgataaacattatatcatcagtaaagaagttgctaaccgtcataatgacagcatcatatgacgagttttgcatacgtttgtcgcccttagaagcaaaagagacagaccaattgtctaacgccgatctagaatcgtgatt

SEQ ID NO: 1180 - DNA, 200 bp, Euphorbia heterophylla
tgtttactcagattcattatcacttctaaaatttcaggcaccactttgcaacctcaaagaaatgaggatcacaaaaggcagaaatcacttcccgttggactttattcccgaggtacccttcttgcaaatctattgacaagaatggatgtcaataattcaaccgaaaccatatgaactattgcaggtaatttatatgccac

SEQ ID NO: 1181 - DNA, 200 bp, Euphorbia heterophylla
gtggcatataaattacctgcaatagttcatatggtttcggttgaattattgacatccattcttgtcaatagatttgcaagaagggtacctcgggaataaagtccaacgggaagtgatttctgccttttgtgatcctcatttctttgaggttgcaaagtggtgcctgaaattttagaagtgataatgaatctgagtaaaca

SEQ ID NO: 1182 - DNA, 200 bp, Euphorbia heterophylla
attgcgtgattgtaggaggtggaatcactggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaacc

SEQ ID NO: 1183 - DNA, 200 bp, Euphorbia heterophylla
ggttagcataggatcggagggctggaaactgttaggcccctcttcccagagatagccgtccctttcaacggtgttgatgttgccaccgacgcgatctctagcctcggtgacaataacgttgggagcaacattccggtgcttagtggcaagtgcctgagcaatgcagagaccagtgattccacctcctacaatcacgcaat

SEQ ID NO: 1184 - DNA, 200 bp, Euphorbia heterophylla
ccagccctccgatcctatgctaaccatggcggtggatagtggtttgaaggatgacctagttttgggggatcctacagcgccacggtttgtattgtgggatgggcaattgaggccagttccttctaagccaagtgacttgccgttctttgatttgatgagcattggtggaaaactcagagctggttttggtgctcttggac

SEQ ID NO: 1185 - DNA, 200 bp, Euphorbia heterophylla
gtccaagagcaccaaaaccagctctgagttttccaccaatgctcatcaaatcaaagaacggcaagtcacttggcttagaaggaactggcctcaattgcccatcccacaatacaaaccgtggcgctgtaggatcccccaaaactaggtcatccttcaaaccactatccaccgccatggttagcataggatcggagggctgg

SEQ ID NO: 1186 - DNA, 200 bp, Euphorbia heterophylla
agagctggttttggtgctcttggacttcggcctccacctccaggacgtgaggaatcagttgaagagtttgtgcgccgcaaccttggagatgaagttttcgagcgtttgattgagccattttgttcaggtgtttatgcaggtgatcctgcaaaactcagcatgaaagcagcattcggaaaagtttggatgctggaacaaaa

SEQ ID NO: 1187 - DNA, 200 bp, Euphorbia heterophylla
ttttgttccagcatccaaacttttccgaatgctgctttcatgctgagttttgcaggatcacctgcataaacacctgaacaaaatggctcaatcaaacgctcgaaaacttcatctccaaggttgcggcgcacaaactcttcaactgattcctcacgtcctggaggtggaggccgaagtccaagagcaccaaaaccagctct

SEQ ID NO: 1188 - DNA, 200 bp, Euphorbia heterophylla
gaaaagtttggatgctggaacaaaatggaggcagtatcattggtggcacttttaaagcaatccaggaaaggaataaaaatcccaagcctcctcgagacccgcgtctaccaaaaccaaagggccaaacagtagggtcttttaggaagggactgactatgcttccagaggcaattgcatcaagtttgggtagtaatatcaag

SEQ ID NO: 1189 - DNA, 200 bp, Euphorbia heterophylla
cttgatattactacccaaacttgatgcaattgcctctggaagcatagtcagtcccttcctaaaagaccctactgtttggccctttggttttggtagacgcgggtctcgaggaggcttgggatttttattcctttcctggattgctttaaaagtgccaccaatgatactgcctccattttgttccagcatccaaacttttc

SEQ ID NO: 1190 - DNA, 200 bp, Euphorbia heterophylla
atcaagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctacaactgctgctgaggcactgt

SEQ ID NO: 1191 - DNA, 200 bp, Euphorbia heterophylla
acagtgcctcagcagcagttgtagaaagaggattcaggatattgctggcaatatgggatggaattgtaagtacgacactcttgctctgcacagtaactgatccttcaggtgtttcatatgttaaactgtactcccgattgtccaatttagagatacccagaagcttccaagataacttgatattactacccaaacttgat

SEQ ID NO: 1192 - DNA, 200 bp, Euphorbia heterophylla
tctacaactgctgctgaggcactgtcaaaattttattacccaccagtagctgctgtgtctatttcatacccgaaagatgcaattcggacagaacgtttaatagatggcgagcttaagggatttggtcagttgcatcctcgtagtcaaggagtggaaactttaggaaccatatacagctcatcacttttccctaaccgagc

SEQ ID NO: 1193 - DNA, 200 bp, Euphorbia heterophylla
gctcggttagggaaaagtgatgagctgtatatggttcctaaagtttccactccttgactacgaggatgcaactgaccaaatcccttaagctcgccatctattaaacgttctgtccgaattgcatctttcgggtatgaaatagacacagcagctactggtgggtaataaaattttgacagtgcctcagcagcagttgtaga

SEQ ID NO: 1194 - DNA, 200 bp, Euphorbia heterophylla
gctcatcacttttccctaaccgagcaccagatggaagaattttgctcttgaattacattgggggtgctaccaatcctggaatattggccaagaaagacagcgaacttgttgaagcagttgaccgtgatctgcgaaagatgctcataaatcccaatgcaaaggatccacttacacttggcgtaagagtgtggcctcaagcc

SEQ ID NO: 1195 - DNA, 200 bp, Euphorbia heterophylla
ggcttgaggccacactcttacgccaagtgtaagtggatcctttgcattgggatttatgagcatctttcgcagatcacggtcaactgcttcaacaagttcgctgtctttcttggccaatattccaggattggtagcacccccaatgtaattcaagagcaaaattcttccatctggtgctcggttagggaaaagtgatgagc

SEQ ID NO: 1196 - DNA, 200 bp, Euphorbia heterophylla
tggcgtaagagtgtggcctcaagccattccacagtttctgattggtcactacgatatcctagatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaaccc

SEQ ID NO: 1197 - DNA, 200 bp, Euphorbia heterophylla
gggttaggaaattagtaacactggacgcagtttcatatgctccttcaacacattttcccaaagctacaccatacacatagttaccccctaaaaacagcccttccaagccttgttcacttaacgcatttttcgccgtatctaggatatcgtagtgaccaatcagaaactgtggaatggcttgaggccacactcttacgcca

SEQ ID NO: 1198 - DNA, 200 bp, Euphorbia heterophylla
tccagtgttactaatttcctaacccagtatacttataaatagtatctgatgagatttaagcaagagttcaattatgctgcggctaagtactgtgagtttattgagtagtgggtaaaaatgttgctttaggtctgttgtatttgtaatagttgcttcacgtttttcattaaggatggtgtattctctagttatgcattctt

SEQ ID NO: 1199 - DNA, 200 bp, Euphorbia heterophylla
aagaatgcataactagagaatacaccatccttaatgaaaaacgtgaagcaactattacaaatacaacagacctaaagcaacatttttacccactactcaataaactcacagtacttagccgcagcataattgaactcttgcttaaatctcatcagatactatttataagtatactgggttaggaaattagtaacactgga

SEQ ID NO: 1200 - DNA, 200 bp, Euphorbia heterophylla
tacactaataaatttttaaatttaaatacaataaattgtataatcatatataaatttatcaatttatttctttaaaatctataaaaaaaagttaataaaatactatctacagcccttggaaatgattccataaacctaatccgagtacggagttctaaaatacggattgaaccagacttggaataatacttttgtcgaaa

SEQ ID NO: 1201 - DNA, 200 bp, Euphorbia heterophylla
tttcgacaaaagtattattccaagtctggttcaatccgtattttagaactccgtactcggattaggtttatggaatcatttccaagggctgtagatagtattttattaacttttttttatagattttaaagaaataaattgataaatttatatatgattatacaatttattgtatttaaatttaaaaatttattagtgta

SEQ ID NO: 1202 - DNA, 200 bp, Euphorbia heterophylla
acttggaataatacttttgtcgaaagcccagaaagtctgggtccgctcgattaacatgtcaaaacaatagaagaaaatatctttttattttcgtgtaaatgaatttaccagtaaggttgcgtttatcatttgtagccttcgtccaatcagattgacacgctatatttctccttgtcaattgaagataacacagcactatt

SEQ ID NO: 1203 - DNA, 200 bp, Euphorbia heterophylla
aatagtgctgtgttatcttcaattgacaaggagaaatatagcgtgtcaatctgattggacgaaggctacaaatgataaacgcaaccttactggtaaattcatttacacgaaaataaaaagatattttcttctattgttttgacatgttaatcgagcggacccagactttctgggctttcgacaaaagtattattccaagt

SEQ ID NO: 1204 - DNA, 200 bp, Euphorbia heterophylla
caattgaagataacacagcactatttccctattagttctgaggccgccactaaacggcggtgcgcttgcctcttaccaccacctttcgccgccatggcctctatttccgacttgtctcttttccggccaacaccttctcttgttccatcattttccaaacgcaatttaaacaactctatccacaaacaattcaaactccg

SEQ ID NO: 1205 - DNA, 200 bp, Euphorbia heterophylla
cggagtttgaattgtttgtggatagagttgtttaaattgcgtttggaaaatgatggaacaagagaaggtgttggccggaaaagagacaagtcggaaatagaggccatggcggcgaaaggtggtggtaagaggcaagcgcaccgccgtttagtggcggcctcagaactaatagggaaatagtgctgtgttatcttcaattg

SEQ ID NO: 1206 - DNA, 200 bp, Euphorbia heterophylla
ctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcactcgccactaagcaccggaatgttgctcccaatgtt

SEQ ID NO: 1207 - DNA, 200 bp, Euphorbia heterophylla
aacattgggagcaacattccggtgcttagtggcgagtgcctgagcaatgcagagaccagtgattccacctcctacaatcacgcaatctactgaggcggaatgtccgttgccggataaggatttgtctccgggattggatggggaaattgtggaaggctgctctgtaattgagcatcggagtttgaattgtttgtggatag

SEQ ID NO: 1208 - DNA, 200 bp, Euphorbia heterophylla
gcaccggaatgttgctcccaatgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattgattgtcatgtctaacaaattattgacgaaattt

SEQ ID NO: 1209 - DNA, 200 bp, Euphorbia heterophylla
aaatttcgtcaataatttgttagacatgacaatcaattagaaattggatcctcaccgccatggttagcataggatcggagggctggaaactgttaggcccctcttcccagagatagccgtccctttcaacggtgttgatgttgccaccgacgcgatctctagcctcggtgacaataacattgggagcaacattccggtgc

SEQ ID NO: 1210 - DNA, 200 bp, Euphorbia heterophylla
gtctaacaaattattgacgaaatttgcttgtaattggagattttggttgaattagctaatttgatcgtattgtaggtggatagtggtttgaaggatgacctagttttgggggatcctactgcgccacggtttgtattgtgggatggacaattgaggccagttccttctaagccaagtgacttgccgttctttgatttgat

SEQ ID NO: 1211 - DNA, 200 bp, Euphorbia heterophylla
atcaaatcaaagaacggcaagtcacttggcttagaaggaactggcctcaattgtccatcccacaatacaaaccgtggcgcagtaggatcccccaaaactaggtcatccttcaaaccactatccacctacaatacgatcaaattagctaattcaaccaaaatctccaattacaagcaaatttcgtcaataatttgttagac

SEQ ID NO: 1212 - DNA, 200 bp, Euphorbia heterophylla
gtgacttgccgttctttgatttgatgagcattggtggaaaactcagagctggttttggtgctcttggacttcggcctccacctccagtttgtcctctttaactttcttattgtaattgttctccgattgaaaatagttccccgtgtgtaattttatctgctcgaaaccttacaattctgctgaaagtgacagggacgtga

SEQ ID NO: 1213 - DNA, 200 bp, Euphorbia heterophylla
tcacgtccctgtcactttcagcagaattgtaaggtttcgagcagataaaattacacacggggaactattttcaatcggagaacaattacaataagaaagttaaagaggacaaactggaggtggaggccgaagtccaagagcaccaaaaccagctctgagttttccaccaatgctcatcaaatcaaagaacggcaagtcac

SEQ ID NO: 1214 - DNA, 200 bp, Euphorbia heterophylla
tctgctgaaagtgacagggacgtgaggaatcagttgaagagtttgtgcgccgcaaccttggagatgaagttttcgagcgtttgattgagccattttgttcaggtaagttaagatatttgtagcttgtagtgttcttattagttgacactgtatcatgtcaagttgtgttatcagacccaatacaacatcttactaatcat

SEQ ID NO: 1215 - DNA, 200 bp, Euphorbia heterophylla
atgattagtaagatgttgtattgggtctgataacacaacttgacatgatacagtgtcaactaataagaacactacaagctacaaatatcttaacttacctgaacaaaatggctcaatcaaacgctcgaaaacttcatctccaaggttgcggcgcacaaactcttcaactgattcctcacgtccctgtcactttcagcaga

SEQ ID NO: 1216 - DNA, 200 bp, Euphorbia heterophylla
cccaatacaacatcttactaatcatcacatgaatattgctgtatttcccatgtaaaattaaaccgatacaacatacctcgacttaaattgatgaatacaattcaatgtagtggtacttagttgacgtccctcttggttcgacgacctcttttaattatgatatgttgtgtttatctaaacactaatttatgaatttcatt

SEQ ID NO: 1217 - DNA, 200 bp, Euphorbia heterophylla
aatgaaattcataaattagtgtttagataaacacaacatatcataattaaaagaggtcgtcgaaccaagagggacgtcaactaagtaccactacattgaattgtattcatcaatttaagtcgaggtatgttgtatcggtttaattttacatgggaaatacagcaatattcatgtgatgattagtaagatgttgtattggg

SEQ ID NO: 1218 - DNA, 200 bp, Euphorbia heterophylla
taaacactaatttatgaatttcattcaaaatctatgccattgttaatacaaatcattatcaaacttgaaatgaattccattattgaagtttatattgcatgctcaatctgatatttgattcatttatttaagtagtcctttagcgtgcatatcgtgaatggttccttgagatgtgcttttgatcatgtagcatccatcat

SEQ ID NO: 1219 - DNA, 200 bp, Euphorbia heterophylla
atgatggatgctacatgatcaaaagcacatctcaaggaaccattcacgatatgcacgctaaaggactacttaaataaatgaatcaaatatcagattgagcatgcaatataaacttcaataatggaattcatttcaagtttgataatgatttgtattaacaatggcatagattttgaatgaaattcataaattagtgttta

SEQ ID NO: 1220 - DNA, 200 bp, Euphorbia heterophylla
cttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatgatgtatgcttctcaaacttaaaatcgccctagttgattttgttg

SEQ ID NO: 1221 - DNA, 200 bp, Euphorbia heterophylla
caacaaaatcaactagggcgattttaagtttgagaagcatacatcatagggaaaccaactgactctttttcagatactgcaaagcaattaaacacctctggacagcatagacaagttacccatttagtcattctcttatcatcttatatatagctagaacaaataagccatcaccatgatggatgctacatgatcaaaag

SEQ ID NO: 1222 - DNA, 200 bp, Euphorbia heterophylla
aaaatcgccctagttgattttgttgctaaagtcggaagttttatttgtataatttgtatatcttgacaaggttgtccttaatgggagatgctatttttcatgtgcaggtgtttatgcaggtgatcctgcaaaactcagcatgaaagcagcattcggaaaagtttggatgctggaacaaaatggaggcagtatcattggtg

SEQ ID NO: 1223 - DNA, 200 bp, Euphorbia heterophylla
caccaatgatactgcctccattttgttccagcatccaaacttttccgaatgctgctttcatgctgagttttgcaggatcacctgcataaacacctgcacatgaaaaatagcatctcccattaaggacaaccttgtcaagatatacaaattatacaaataaaacttccgactttagcaacaaaatcaactagggcgatttt

SEQ ID NO: 1224 - DNA, 200 bp, Euphorbia heterophylla
caaaatggaggcagtatcattggtggcacttttaaagcaatccaggaaaggaataaaaatcccaagcctcctcgagacccgtatatttatctccttgctttgagaatatcttacatcttttgtttttgtttagtttcttgactctagtgccctgcaggcgtctaccaaaaccaaagggccaaacagtagggtcttttagg

SEQ ID NO: 1225 - DNA, 200 bp, Euphorbia heterophylla
cctaaaagaccctactgtttggccctttggttttggtagacgcctgcagggcactagagtcaagaaactaaacaaaaacaaaagatgtaagatattctcaaagcaaggagataaatatacgggtctcgaggaggcttgggatttttattcctttcctggattgctttaaaagtgccaccaatgatactgcctccattttg

SEQ ID NO: 1226 - DNA, 200 bp, Euphorbia heterophylla
gggccaaacagtagggtcttttaggaagggactgactatgcttccagaggcaattgcatcaaggtaacatttccaccggaattgaattttatgaactttagatggttgtaataattcttgacagtggctgaagtaattgactgattacctgcattggtgttgcagtttgggtagtaatatcaagttatcttggaagcttc

SEQ ID NO: 1227 - DNA, 200 bp, Euphorbia heterophylla
gaagcttccaagataacttgatattactacccaaactgcaacaccaatgcaggtaatcagtcaattacttcagccactgtcaagaattattacaaccatctaaagttcataaaattcaattccggtggaaatgttaccttgatgcaattgcctctggaagcatagtcagtcccttcctaaaagaccctactgtttggccc

SEQ ID NO: 1228 - DNA, 200 bp, Euphorbia heterophylla
tttattgtgtaataattaaaggataatattactgtaaaataatttatattatttaatataataattttaatattattatttttccttaaaagaattataaatgagcttgtaatgttcatgaacaatccatgaataagccaattgttaaatagaccattcatgaatatgcattttgagctcgaattaaactcagcttattt

SEQ ID NO: 1229 - DNA, 200 bp, Euphorbia heterophylla
aaataagctgagtttaattcgagctcaaaatgcatattcatgaatggtctatttaacaattggcttattcatggattgttcatgaacattacaagctcatttataattcttttaaggaaaaataataatattaaaattattatattaaataatataaattattttacagtaatattatcctttaattattacacaataaa

SEQ ID NO: 1230 - DNA, 200 bp, Euphorbia heterophylla
agctcgaattaaactcagcttatttacattgttgtacatgtgaaatcaagagaatgctcataaagtgagtattaaaccgaaacattttatatttcttaaaggtctgacacatgaattctgagaaatcaaatctgtaatattttgacaaatgaaataaatcgtaaaatacatatattcattttagtaaaatctctaaattt

SEQ ID NO: 1231 - DNA, 200 bp, Euphorbia heterophylla
aaatttagagattttactaaaatgaatatatgtattttacgatttatttcatttgtcaaaatattacagatttgatttctcagaattcatgtgtcagacctttaagaaatataaaatgtttcggtttaatactcactttatgagcattctcttgatttcacatgtacaacaatgtaaataagctgagtttaattcgagct

SEQ ID NO: 1232 - DNA, 200 bp, Euphorbia heterophylla
tcattttagtaaaatctctaaatttttaattctttcaatcttaacatcttcttcctcaaatccttgtaacaaatcacagcacaatattttagcattcaaattcatagaatataattaaccgttcaaatctaccaatcccacctccttacccacagcttctactccgagtccattcattaaccctcctctctttgttacaa

SEQ ID NO: 1233 - DNA, 200 bp, Euphorbia heterophylla
ttgtaacaaagagaggagggttaatgaatggactcggagtagaagctgtgggtaaggaggtgggattggtagatttgaacggttaattatattctatgaatttgaatgctaaaatattgtgctgtgatttgttacaaggatttgaggaagaagatgttaagattgaaagaattaaaaatttagagattttactaaaatga

SEQ ID NO: 1234 - DNA, 200 bp, Euphorbia heterophylla
attaaccctcctctctttgttacaaattcttccatgtcttatttttactaaaatctatgctatctatgtttcctaaaattattccacctgctttcagttttaataaaacttcagatactttgaagaactccaacactccattaaatgagaccaagtttcgcaagtcgggctaccctttgttgggcccaagcgcaatttgg

SEQ ID NO: 1235 - DNA, 200 bp, Euphorbia heterophylla
ccaaattgcgcttgggcccaacaaagggtagcccgacttgcgaaacttggtctcatttaatggagtgttggagttcttcaaagtatctgaagttttattaaaactgaaagcaggtggaataattttaggaaacatagatagcatagattttagtaaaaataagacatggaagaatttgtaacaaagagaggagggttaat

SEQ ID NO: 1236 - DNA, 200 bp, Euphorbia heterophylla
tttgttgggcccaagcgcaatttggacacctattttttactaagttcggcttaagcctcagcccgtcaaaatttaaagttttatgcgttgagctgggttttttacaattatccgagcctaatccgataaataataatttaattttttttatatattatatattgtactaaataattatttcaatatttatatttcaaagt

SEQ ID NO: 1237 - DNA, 200 bp, Euphorbia heterophylla
actttgaaatataaatattgaaataattatttagtacaatatataatatataaaaaaaattaaattattatttatcggattaggctcggataattgtaaaaaacccagctcaacgcataaaactttaaattttgacgggctgaggcttaagccgaacttagtaaaaaataggtgtccaaattgcgcttgggcccaacaaa

SEQ ID NO: 1238 - DNA, 200 bp, Euphorbia heterophylla
tatttcaatatttatatttcaaagttatgggtgtgcatctggttaaaacctaatagaatcgaataaatcgaatatcaaatagagaaaccaaaccaaatacgaatcaaaatcgaattaaccaaatcaaaaataaattattccgtttggttaaaaaccgaaccaaaccaaatttttttaaaaaacaaacttaaattaaaaat

SEQ ID NO: 1239 - DNA, 200 bp, Euphorbia heterophylla
atttttaatttaagtttgttttttaaaaaaatttggtttggttcggtttttaaccaaacggaataatttatttttgatttggttaattcgattttgattcgtatttggtttggtttctctatttgatattcgatttattcgattctattaggttttaaccagatgcacacccataactttgaaatataaatattgaaata

SEQ ID NO: 1240 - DNA, 200 bp, Euphorbia heterophylla
taaaaaacaaacttaaattaaaaattttaactcttaaaatccaaaaataagtattacaatagttcaaatgacttagttttgacacataaatgaatgagggtgcattttggggtttgatgttaaaatgatctatatttgagcattattagtagaatattttaaatttttattatgatatttcaattcgattcggttattgt

SEQ ID NO: 1241 - DNA, 200 bp, Euphorbia heterophylla
acaataaccgaatcgaattgaaatatcataataaaaatttaaaatattctactaataatgctcaaatatagatcattttaacatcaaaccccaaaatgcaccctcattcatttatgtgtcaaaactaagtcatttgaactattgtaatacttatttttggattttaagagttaaaatttttaatttaagtttgtttttta

SEQ ID NO: 1242 - DNA, 200 bp, Euphorbia heterophylla
tatttcaattcgattcggttattgtagttttttcaacactaaaactgaactgaaaattgaaatgtttaactttaataaataaaccgaaccgaattttcaaagtaaccgaaccaaattaataactcagtcttattcgattcggaaatgtagttaccaaaaccatttgcacacccatattttacactaatgaatttttaaac

SEQ ID NO: 1243 - DNA, 200 bp, Euphorbia heterophylla
gtttaaaaattcattagtgtaaaatatgggtgtgcaaatggttttggtaactacatttccgaatcgaataagactgagttattaatttggttcggttactttgaaaattcggttcggtttatttattaaagttaaacatttcaattttcagttcagttttagtgttgaaaaaactacaataaccgaatcgaattgaaata

SEQ ID NO: 1244 - DNA, 200 bp, Euphorbia heterophylla
attttacactaatgaatttttaaacttaaatacaataaattgtataaattattaaaaatttcaaataaataatataatcatacgtaattttgtcaatttatttcttaaaatctataaaaaaaaaagttattaaaatactatctacagcctttggaaatgattccataagcctgatccgagcacggagttctaaaatacgg

SEQ ID NO: 1245 - DNA, 200 bp, Euphorbia heterophylla
ccgtattttagaactccgtgctcggatcaggcttatggaatcatttccaaaggctgtagatagtattttaataacttttttttttatagattttaagaaataaattgacaaaattacgtatgattatattatttatttgaaatttttaataatttatacaatttattgtatttaagtttaaaaattcattagtgtaaaat

SEQ ID NO: 1246 - DNA, 200 bp, Euphorbia heterophylla
ccgagcacggagttctaaaatacggattgaagcagacttggaatgatacttttgtcgaaagcccacaaagtctggcctgttcgattaacatgtcaaaacaatagaagaaaatatctttttattttcgtgtaaatgaatttaccagtaaggttgcgtttatcatttgtagccttcgtccaatcagattgacacgctatatt

SEQ ID NO: 1247 - DNA, 200 bp, Euphorbia heterophylla
aatatagcgtgtcaatctgattggacgaaggctacaaatgataaacgcaaccttactggtaaattcatttacacgaaaataaaaagatattttcttctattgttttgacatgttaatcgaacaggccagactttgtgggctttcgacaaaagtatcattccaagtctgcttcaatccgtattttagaactccgtgctcgg

SEQ ID NO: 1248 - DNA, 200 bp, Euphorbia heterophylla
tccaatcagattgacacgctatatttctccttgtcaattgaagataacacagcactatttccctattagttctgaggccgccactaaacggagtgcgcttgcctcttaccaccacctttcgccgccatggcctctatttccgacttgtctcttttccggccaacaccttctcttgttccatcattttccaaacgcaattt

SEQ ID NO: 1249 - DNA, 200 bp, Euphorbia heterophylla
aaattgcgtttggaaaatgatggaacaagagaaggtgttggccggaaaagagacaagtcggaaatagaggccatggcggcgaaaggtggtggtaagaggcaagcgcactccgtttagtggcggcctcagaactaatagggaaatagtgctgtgttatcttcaattgacaaggagaaatatagcgtgtcaatctgattgga

SEQ ID NO: 1250 - DNA, 200 bp, Euphorbia heterophylla
ttccatcattttccaaacgcaatttaaacaactctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcactt

SEQ ID NO: 1251 - DNA, 200 bp, Euphorbia heterophylla
aagtgcctgagcaatgcagagaccagtgattccacctcctacaatcacgcaatctactgaggcggaatgtccgttgccggataaggatttgtctccgggattggatggggaaattgtggaaggctgctctgtaattgagcatcggagtttgaattgtttgtggatagagttgtttaaattgcgtttggaaaatgatggaa

SEQ ID NO: 1252 - DNA, 200 bp, Euphorbia heterophylla
tggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattg

SEQ ID NO: 1253 - DNA, 200 bp, Euphorbia heterophylla
caattagaaattggatcctcaccgccatggttagcataggatcggagggctggaaactgttaggcccctcttcccagagatagccgtccctttcaacggtgttgatgttgccaccgacgcgatctctagcctcggtgacaataacgttgggagcaacattccggtgcttagtggcaagtgcctgagcaatgcagagacca

SEQ ID NO: 1254 - DNA, 200 bp, Euphorbia heterophylla
gcggtgaggatccaatttctaattgattgtcatgtctaacaaattattgacgaaatttgcttgtaattggagattttggttgaattagctaatttgatcgtattgtaggtggatagtggtttgaaggatgacctagttttgggggatcctactgcgccacggtttgtattgtgggatgggcaattgaggccagttccttc

SEQ ID NO: 1255 - DNA, 200 bp, Euphorbia heterophylla
gaaggaactggcctcaattgcccatcccacaatacaaaccgtggcgcagtaggatcccccaaaactaggtcatccttcaaaccactatccacctacaatacgatcaaattagctaattcaaccaaaatctccaattacaagcaaatttcgtcaataatttgttagacatgacaatcaattagaaattggatcctcaccgc

SEQ ID NO: 1256 - DNA, 200 bp, Euphorbia heterophylla
atgggcaattgaggccagttccttctaagccaagtgacttgccgttctttgatttgatgagcattggtggaaaactcagagctggttttggtgctcttggacttcggcctccacctccagtttgtcctctttaactttcttattgtaattgttctccgattgaaaatagtcccccgtgtgtaattttatctgctcgtaac

SEQ ID NO: 1257 - DNA, 200 bp, Euphorbia heterophylla
gttacgagcagataaaattacacacgggggactattttcaatcggagaacaattacaataagaaagttaaagaggacaaactggaggtggaggccgaagtccaagagcaccaaaaccagctctgagttttccaccaatgctcatcaaatcaaagaacggcaagtcacttggcttagaaggaactggcctcaattgcccat

SEQ ID NO: 1258 - DNA, 200 bp, Euphorbia heterophylla
gtgtgtaattttatctgctcgtaaccttacaattctgctgaaagtgacagggacgtgaggaatcagttgaagagtttgtgcgccgcaaccttggagatgaagttttcgagcgtttgattgagccattttgttcaggtaagttaagatatttggagcttgtagtgttcttattagttgacactgtatcatgtcaagttgtg

SEQ ID NO: 1259 - DNA, 200 bp, Euphorbia heterophylla
cacaacttgacatgatacagtgtcaactaataagaacactacaagctccaaatatcttaacttacctgaacaaaatggctcaatcaaacgctcgaaaacttcatctccaaggttgcggcgcacaaactcttcaactgattcctcacgtccctgtcactttcagcagaattgtaaggttacgagcagataaaattacacac

SEQ ID NO: 1260 - DNA, 200 bp, Euphorbia heterophylla
tgacactgtatcatgtcaagttgtgttatcagacccattacaacatcttaccaatcatcacatgaatattgctgtatttcccatgtaaaattaaaccgatacaacatacctcgacttaaattgacgaatacaattcaatgtagtggtacttagttgacgtcccttttggttcgacgacctcttttaattatgatatgttg

SEQ ID NO: 1261 - DNA, 200 bp, Euphorbia heterophylla
caacatatcataattaaaagaggtcgtcgaaccaaaagggacgtcaactaagtaccactacattgaattgtattcgtcaatttaagtcgaggtatgttgtatcggtttaattttacatgggaaatacagcaatattcatgtgatgattggtaagatgttgtaatgggtctgataacacaacttgacatgatacagtgtca

SEQ ID NO: 1262 - DNA, 200 bp, Euphorbia heterophylla
gacctcttttaattatgatatgttgtgttatatctaaacactaaattatgaatttcattcaaaatctatgccattgttaatacaaatcattatcaaacttgaagtgaattccattattgaagtttatattgcatgctcaatctcatccatctgatatttgattcatttatttaagtagtcctttagcgtgcatatcgtga

SEQ ID NO: 1263 - DNA, 200 bp, Euphorbia heterophylla
tcacgatatgcacgctaaaggactacttaaataaatgaatcaaatatcagatggatgagattgagcatgcaatataaacttcaataatggaattcacttcaagtttgataatgatttgtattaacaatggcatagattttgaatgaaattcataatttagtgtttagatataacacaacatatcataattaaaagaggtc

SEQ ID NO: 1264 - DNA, 200 bp, Euphorbia heterophylla
tagtcctttagcgtgcatatcgtgaatggttccttgagatgtgcttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatga

SEQ ID NO: 1265 - DNA, 200 bp, Euphorbia heterophylla
tcatagggaaaccaactgactctttttcagatactgcaaagcaattaaacacctctggacagcatagacaagttacccatttagtcattctcttatcatcttatatatagctagaacaaataagccatcaccatgatggatgctacatgatcaaaagcacatctcaaggaaccattcacgatatgcacgctaaaggacta

SEQ ID NO: 1266 - DNA, 200 bp, Euphorbia heterophylla
aaagagtcagttggtttccctatgatgtatgcttctcaaacttaaaatcgccctagttgattttgttgctaaattcggaagttttatttgtataatttgtatatcttgacaaggttgtccttaatgggagatgctatttttcatgtgcaggtgtttatgcaggtgatcctgcaaaactcagcatgaaagcagcattcgga

SEQ ID NO: 1267 - DNA, 200 bp, Euphorbia heterophylla
tccgaatgctgctttcatgctgagttttgcaggatcacctgcataaacacctgcacatgaaaaatagcatctcccattaaggacaaccttgtcaagatatacaaattatacaaataaaacttccgaatttagcaacaaaatcaactagggcgattttaagtttgagaagcatacatcatagggaaaccaactgactcttt

SEQ ID NO: 1268 - DNA, 200 bp, Euphorbia heterophylla
actcagcatgaaagcagcattcggaaaagtttggatgctggaacaaaatggaggcagtatcattggtggcacttttaaagcaatccaggaaaggaataaaaatcccaagcctcctcgagacccgtatatttatctccttgctttgagaatatcttacatcttttgtttttgttgagtttcttgactctagtgccctgcag

SEQ ID NO: 1269 - DNA, 200 bp, Euphorbia heterophylla
ctgcagggcactagagtcaagaaactcaacaaaaacaaaagatgtaagatattctcaaagcaaggagataaatatacgggtctcgaggaggcttgggatttttattcctttcctggattgctttaaaagtgccaccaatgatactgcctccattttgttccagcatccaaacttttccgaatgctgctttcatgctgagt

SEQ ID NO: 1270 - DNA, 200 bp, Euphorbia heterophylla
gtttcttgactctagtgccctgcaggcgtctaccaaaaccaaagggccaaacagtagggtcttttaggaagggactgactatgcttccagaggcaattgcatcaaggtaacatttccaccggaattaaaattttatgaactttagatggttgtaataattcttgacagtggctgaagtaattgactgattacctgcattg

SEQ ID NO: 1271 - DNA, 200 bp, Euphorbia heterophylla
caatgcaggtaatcagtcaattacttcagccactgtcaagaattattacaaccatctaaagttcataaaattttaattccggtggaaatgttaccttgatgcaattgcctctggaagcatagtcagtcccttcctaaaagaccctactgtttggccctttggttttggtagacgcctgcagggcactagagtcaagaaac

SEQ ID NO: 1272 - DNA, 200 bp, Euphorbia heterophylla
agtaattgactgattacctgcattggtgttgcagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcct

SEQ ID NO: 1273 - DNA, 200 bp, Euphorbia heterophylla
aggattcaggatattgctggcaatatgggatggaattgtaagtacgacactcttgctctgcacagtaactgatccttcaggtgtttcatatgttaaactgtactcccgattgtccaatttagagatacccagaagcttccaagataacttgatattactacccaaactgcaacaccaatgcaggtaatcagtcaattact

SEQ ID NO: 1274 - DNA, 77 bp, Euphorbia heterophylla; identical to SEQ ID NO: 48

SEQ ID NO: 1275 - DNA, 77 bp, Euphorbia heterophylla
tactctgaaaattcggttcggtttgtttattaaagttaaacatttcaattttcaattcagttttagtgttgaaaaaa

SEQ ID NO: 1276 - DNA, 200 bp, Kochia scoparia
atacactgctctacaatctcaacctcaactccaacctcaagttcaaacccaggaacacttggcgaaggaggattattggattgtgtgatcgtgggaggtggtattagtgggctctgcattgcacaagcactttctacaaagtactcttctctttctacaaatttcattgttaccgaggcgaaagatcgagttggtggcaa

SEQ ID NO: 1277 - DNA, 200 bp, Kochia scoparia
ttgccaccaactcgatctttcgcctcggtaacaatgaaatttgtagaaagagaagagtactttgtagaaagtgcttgtgcaatgcagagcccactaataccacctcccacgatcacacaatccaataatcctccttcgccaagtgttcctgggtttgaacttgaggttggagttgaggttgagattgtagagcagtgtat

SEQ ID NO: 1278 - DNA, 200 bp, Kochia scoparia
aggcgaaagatcgagttggtggcaacattaccaccaaggaggatgatggctatatctgggaagaaggacccaacagttttcagccgtctgatgcagttctcaccatggctgttgattgtgggttgaaagatgaattggtgtttggtgaccccaaagcacctcgatttgtgctgtggaatgggaaattaaggcgggtacct

SEQ ID NO: 1279 - DNA, 200 bp, Kochia scoparia
aggtacccgccttaatttcccattccacagcacaaatcgaggtgctttggggtcaccaaacaccaattcatctttcaacccacaatcaacagccatggtgagaactgcatcagacggctgaaaactgttgggtccttcttcccagatatagccatcatcctccttggtggtaatgttgccaccaactcgatctttcgcct

SEQ ID NO: 1280 - DNA, 200 bp, Kochia scoparia
gaatgggaaattaaggcgggtaccttctaagctcacagatctccctttctttgatcttatgagctttcctggcaagattagagctggccttggcgctcttggatttcgtccttctccaccaggtcgtgaagaatctgttgaggattttgttcgtcgaaatcttggcgatgaggtctttgaacgtttgattgaaccttttt

SEQ ID NO: 1281 - DNA, 200 bp, Kochia scoparia
aaaaaggttcaatcaaacgttcaaagacctcatcgccaagatttcgacgaacaaaatcctcaacagattcttcacgacctggtggagaaggacgaaatccaagagcgccaaggccagctctaatcttgccaggaaagctcataagatcaaagaaagggagatctgtgagcttagaaggtacccgccttaatttcccattc

SEQ ID NO: 1282 - DNA, 200 bp, Kochia scoparia
tttgaacgtttgattgaacctttttgttcaggtgtgtatgctggtgatcctgccaagttaagcatgaaagctgcttttggcagagtgtgggttttggagcagatgggtggtaatatcattggtggcgctctcaaaactatccaggaaaagaagaataagcctaagccgcctcgagatccgcgccttccgaagccaaaggg

SEQ ID NO: 1283 - DNA, 200 bp, Kochia scoparia
ccctttggcttcggaaggcgcggatctcgaggcggcttaggcttattcttcttttcctggatagttttgagagcgccaccaatgatattaccacccatctgctccaaaacccacactctgccaaaagcagctttcatgcttaacttggcaggatcaccagcatacacacctgaacaaaaaggttcaatcaaacgttcaaa

SEQ ID NO: 1284 - DNA, 200 bp, Kochia scoparia
atccgcgccttccgaagccaaagggtcagacagttggatcctttaggaaaggactcattatgttgccgaacgccatttctgctaggcttggaagtaaagtgaaactttcttggactctagctagtatttctaagacacacaatggggaatataatttgatttatgatacaccagatggaccggtttccgtaaggactaaa

SEQ ID NO: 1285 - DNA, 200 bp, Kochia scoparia
tttagtccttacggaaaccggtccatctggtgtatcataaatcaaattatattccccattgtgtgtcttagaaatactagctagagtccaagaaagtttcactttacttccaagcctagcagaaatggcgttcggcaacataatgagtcctttcctaaaggatccaactgtctgaccctttggcttcggaaggcgcggat

SEQ ID NO: 1286 - DNA, 200 bp, Kochia scoparia
tggaccggtttccgtaaggactaaaagtatcgtgatgactattccatcatatgttgcaagtagtctgcttcgtccattctcagatgctgctgcagattccctttcaaaatttcactatccacctgttgcagcagtgtcactgtcttatcctgaagaagcgattagacctgagtgcttgattgatggtaaacttcaaggat

SEQ ID NO: 1287 - DNA, 200 bp, Kochia scoparia
atccttgaagtttaccatcaatcaagcactcaggtctaatcgcttcttcaggataagacagtgacactgctgcaacaggtggatagtgaaattttgaaagggaatctgcagcagcatctgagaatggacgaagcagactacttgcaacatatgatggaatagtcatcacgatacttttagtccttacggaaaccggtcca

SEQ ID NO: 1288 - DNA, 200 bp, Kochia scoparia
ttgattgatggtaaacttcaaggattcgggcaactgcatccccgcagtcagggtgtggaaaccttgggatcaatttatagttcatctcttttccctggtcgagcaccacctggtaggaccatgatcttgagcttcattggaggtgctactaatcctggcatagtagacaagacgcaagatgaacttgctaagactgttga

SEQ ID NO: 1289 - DNA, 200 bp, Kochia scoparia
tcaacagtcttagcaagttcatcttgcgtcttgtctactatgccaggattagtagcacctccaatgaagctcaagatcatggtcctaccaggtggtgctcgaccagggaaaagagatgaactataaattgatcccaaggtttccacaccctgactgcggggatgcagttgcccgaatccttgaagtttaccatcaatcaa

SEQ ID NO: 1290 - DNA, 200 bp, Kochia scoparia
aagatgaacttgctaagactgttgacaaggacctgagaagaattcttataaatccaagtgcaaaagatcctcgtgttctaggcgtgaaagtatggcctcaagcaataccccaatttttgataggccactttgatctgcttgatgctgcaaaagctgctttgactgatgctgggtgtaaaggattgtttcttggaggaaac

SEQ ID NO: 1291 - DNA, 200 bp, Kochia scoparia
gtttcctccaagaaacaatcctttacacccagcatcagtcaaagcagcttttgcagcatcaagcagatcaaagtggcctatcaaaaattggggtattgcttgaggccatactttcacgcctagaacacgaggatcttttgcacttggatttataagaattcttctcaggtccttgtcaacagtcttagcaagttcatctt

SEQ ID NO: 1292 - DNA, 200 bp, Kochia scoparia; identical to SEQ ID NO: 1276

SEQ ID NO: 1293 - DNA, 200 bp, Kochia scoparia; identical to SEQ ID NO: 1277

SEQ ID NO: 1294 - DNA, 200 bp, Kochia scoparia; identical to SEQ ID NO: 1278

SEQ ID NO: 1295 - DNA, 200 bp, Kochia scoparia; identical to SEQ ID NO: 1279

SEQ ID NO: 1296 - DNA, 200 bp, Kochia scoparia; identical to SEQ ID NO: 1280

SEQ ID NO: 1297 - DNA, 200 bp, Kochia scoparia; identical to SEQ ID NO: 1281

SEQ ID NO: 1298 - DNA, 200 bp, Kochia scoparia; identical to SEQ ID NO: 1282

SEQ ID NO: 1299 - DNA, 200 bp, Kochia scoparia; identical to SEQ ID NO: 1283

SEQ ID NO: 1300 - DNA, 200 bp, Kochia scoparia; identical to SEQ ID NO: 1284

SEQ ID NO: 1301 - DNA, 200 bp, Kochia scoparia; identical to SEQ ID NO: 1285

SEQ ID NO: 1302 - DNA, 200 bp, Kochia scoparia
caggatgctgctgcagattccctttcaaaatttcactatccacctgttgcagcagtgtcactgtcttatcctgaagaagcgattagacctgagtgcttgattgatggtaaacttcaaggattcgggcaactgcatccccgcagtcagggtgtggaaaccttgggatcaatttatagttcatctcttttccctggtcgagc

SEQ ID NO: 1303 - DNA, 200 bp, Kochia scoparia
gctcgaccagggaaaagagatgaactataaattgatcccaaggtttccacaccctgactgcggggatgcagttgcccgaatccttgaagtttaccatcaatcaagcactcaggtctaatcgcttcttcaggataagacagtgacactgctgcaacaggtggatagtgaaattttgaaagggaatctgcagcagcatcctg

SEQ ID NO: 1304 - DNA, 200 bp, Kochia scoparia
gttcatctcttttccctggtcgagcaccacctggtaggaccatgatcttgagcttcattggaggtgctactaatcctggcatagtagacaagacgcaagatgaacttgctaagactgttgacaaggacctgagaagaattcttataaatccaagtgcaaaagatcctcgtgttctaggcgtgaaagtatggcctcaagca

SEQ ID NO: 1305 - DNA, 200 bp, Kochia scoparia
tgcttgaggccatactttcacgcctagaacacgaggatcttttgcacttggatttataagaattcttctcaggtccttgtcaacagtcttagcaagttcatcttgcgtcttgtctactatgccaggattagtagcacctccaatgaagctcaagatcatggtcctaccaggtggtgctcgaccagggaaaagagatgaac

SEQ ID NO: 1306 - DNA, 200 bp, Kochia scoparia
aggcgtgaaagtatggcctcaagcaataccccaatttttgataggccactttgatctgcttgatgctgcaaaagctgctttgactgatgctgggtgtaaaggattgtttcttggaggaaactatgtatcaggtgttgccttggggcggtgtatagagggtgcttatgaatctgcagccgaggtagttgatttcctctccc

SEQ ID NO: 1307 - DNA, 200 bp, Kochia scoparia
gggagaggaaatcaactacctcggctgcagattcataagcaccctctatacaccgccccaaggcaacacctgatacatagtttcctccaagaaacaatcctttacacccagcatcagtcaaagcagcttttgcagcatcaagcagatcaaagtggcctatcaaaaattggggtattgcttgaggccatactttcacgcct

SEQ ID NO: 1308 - DNA, 200 bp, Kochia scoparia
gtaacttgcctacccctctcagttataattactacattcaagaaggttaatgtgaaaagacctcttgagggctttggagttcttgtcccctctgttgagcagaaaaatgggttgaagactcttggtacactattttcctccatcatgtttcctgatcgtgctccctctgatgtgtatctctatacaacctttgttggtgg

SEQ ID NO: 1309 - DNA, 200 bp, Kochia scoparia
ccaccaacaaaggttgtatagagatacacatcagagggagcacgatcaggaaacatgatggaggaaaatagtgtaccaagagtcttcaacccatttttctgctcaacagaggggacaagaactccaaagccctcaagaggtcttttcacattaaccttcttgaatgtagtaattataactgagaggggtaggcaagttac

SEQ ID NO: 1310 - DNA, 200 bp, Kochia scoparia
atctctatacaacctttgttggtggaagcaggaatagtgaacttgcaaaagcttcaacggatgagctgaagcaaatagtttcttctgaccttgagaagctattgggcactgagggtgaacctacctctgtgaatcatttctattggagcaaggcattccctctttatgggcgcaactatgactcagtactcaaagcaatc

SEQ ID NO: 1311 - DNA, 200 bp, Kochia scoparia
gattgctttgagtactgagtcatagttgcgcccataaagagggaatgccttgctccaatagaaatgattcacagaggtaggttcaccctcagtgcccaatagcttctcaaggtcagaagaaactatttgcttcagctcatccgttgaagcttttgcaagttcactattcctgcttccaccaacaaaggttgtatagagat

SEQ ID NO: 1312 - DNA, 150 bp, Lolium multiflorum; identical to SEQ ID NO: 65

SEQ ID NO: 1313 - DNA, 150 bp, Lolium multiflorum
tttcagaccatgtttttgctgttccttatagggtaccaacaccccaaatccttccaggggtcttttgacatcttccttcttaaaagctgttaccatgagggataacggcagataatccacctgcataataaataccaataaggcaggatt

SEQ ID NO: 1314 - DNA, 108 bp, Lolium multiflorum; identical to SEQ ID NO: 68

SEQ ID NO: 1315 - DNA, 108 bp, Lolium multiflorum
accgccaaggagcgtgtccgcctcgaagacgacgggccggcagccgcgctccagcaggtgcttgcacgccgccaggccgctcacgccggcgccgatgatggccaccct

SEQ ID NO: 1316 - DNA, 144 bp, Lolium multiflorum; identical to SEQ ID NO: 66

SEQ ID NO: 1317 - DNA, 144 bp, Lolium multiflorum
cttttctaaattccataacgctggaaatgcatgacggatagataatgactcaggatctcctgcacttgttccagctacaaatggatcaataagatagtcgacaacttcctttccaaaatggcgttcaaagaagctcccaacact

SEQ ID NO: 1318 - DNA, 114 bp, Lolium multiflorum; identical to SEQ ID NO: 67

SEQ ID NO: 1319 - DNA, 114 bp, Lolium multiflorum
cgttggagctccagcgagatccctattgtggcttcccccaacgaatgttgtaaataagtgttggtcattaggagctcgatctgggaacatcatagaggagaagagggttcctat

SEQ ID NO: 1320 - DNA, 200 bp, Lolium multiflorum
ctcgacgcgaacgcgggatctctttcgcgtcaggcgtgaaatagggccggatttccatatacaactactaaccgagaaccccgcccactggaatgcgattcccagcccatcgacctatccaattccaattccagtgggccatgaaaaccgcaaaccaaccaaccaatacagccgcagccgcatcccgtcatccactccgc

SEQ ID NO: 1321 - DNA, 200 bp, Lolium multiflorum
gcggagtggatgacgggatgcggctgcggctgtattggttggttggtttgcggttttcatggcccactggaattggaattggataggtcgatgggctgggaatcgcattccagtgggcggggttctcggttagtagttgtatatggaaatccggccctatttcacgcctgacgcgaaagagatcccgcgttcgcgtcgag

SEQ ID NO: 1322 - DNA, 200 bp, Lolium multiflorum
agccgcatcccgtcatccactccgcactgccatctcccccgcccgagcgacggaaatggtcggcgcaaccatggccaccgctaccgtcacggcggcgctaccgctccgcctccgggtccccgcgcgcccccgacgcggacagacgcgctgcgcggtcgcgagcgatgccaccgaggcgccggccgtgcccagcgcacggc

SEQ ID NO: 1323 - DNA, 200 bp, Lolium multiflorum
gccgtgcgctgggcacggccggcgcctcggtggcatcgctcgcgaccgcgcagcgcgtctgtccgcgtcgggggcgcgcggggacccggaggcggagcggtagcgccgccgtgacggtagcggtggccatggttgcgccgaccatttccgtcgctcgggcgggggagatggcagtgcggagtggatgacgggatgcggct

SEQ ID NO: 1324 - DNA, 200 bp, Lolium multiflorum
gcgccggccgtgcccagcgcacggctgtccgcggattgcgtcatcgtgggcggcggcatcagcggcctctgcaccgcacaggcgctggccaccaagtacggcgtcaccgacttgctcgtcacggaggcccgcgctcgcgcaggcggcaacatcaccaccgtcgagcgccccgacgaggggtacctctgggaggagggccc

SEQ ID NO: 1325 - DNA, 200 bp, Lolium multiflorum
gggccctcctcccagaggtacccctcgtcggggcgctcgacggtggtgatgttgccgcctgcgcgagcgcgggcctccgtgacgagcaagtcggtgacgccgtacttggtggccagcgcctgtgcggtgcagaggccgctgatgccgccgcccacgatgacgcaatccgcggacagccgtgcgctgggcacggccggcgc

SEQ ID NO: 1326 - DNA, 200 bp, Lolium multiflorum
aggggtacctctgggaggagggccccaacagcttccagccctccgaccccgtcctcaccatggccgtacgcaccatgctcgctttctccttcttttccggattcttcgggacgtaggcgtacagaatacagatacgatcgctgaatggattggttgcgcaggtagacagcgggctcaaggatgacttggtgttcggggac

SEQ ID NO: 1327 - DNA, 200 bp, Lolium multiflorum
gtccccgaacaccaagtcatccttgagcccgctgtctacctgcgcaaccaatccattcagcgatcgtatctgtattctgtacgcctacgtcccgaagaatccggaaaagaaggagaaagcgagcatggtgcgtacggccatggtgaggacggggtcggagggctggaagctgttggggccctcctcccagaggtacccct

SEQ ID NO: 1328 - DNA, 200 bp, Lolium multiflorum
caaggatgacttggtgttcggggaccccaatgcgccgcgcttcgtgctgtggcaggggaagctgaggccggtgccgtccaagcctggcgacctgcctttcttcgacctcatgagtattcctgggaagctcagggccggccttggcgcgctcggcattcgtccgcctcctccagtttgtgctctgcccgtgctctctattc

SEQ ID NO: 1329 - DNA, 200 bp, Lolium multiflorum
gaatagagagcacgggcagagcacaaactggaggaggcggacgaatgccgagcgcgccaaggccggccctgagcttcccaggaatactcatgaggtcgaagaaaggcaggtcgccaggcttggacggcaccggcctcagcttcccctgccacagcacgaagcgcggcgcattggggtccccgaacaccaagtcatccttg

SEQ ID NO: 1330 - DNA, 200 bp, Lolium multiflorum
tgtgctctgcccgtgctctctattctttagtgaattttgattgtcaaagatggggctgagcgttcccggcgaaggtttcaggggcgtgaggagtcggtggaggagtttgtgcgccgcaacctcggcgcggaggtctttgagcgcctcatcgagcctttctgctcaggtaatgtgcagtagtatatgtctgttctgttctg

SEQ ID NO: 1331 - DNA, 200 bp, Lolium multiflorum
cagaacagaacagacatatactactgcacattacctgagcagaaaggctcgatgaggcgctcaaagacctccgcgccgaggttgcggcgcacaaactcctccaccgactcctcacgcccctgaaaccttcgccgggaacgctcagccccatctttgacaatcaaaattcactaaagaatagagagcacgggcagagcaca

SEQ ID NO: 1332 - DNA, 200 bp, Lolium multiflorum
agtagtatatgtctgttctgttctgctctgcttcttgcattgatcccgataataagaatataacatttcgatatcaacgttaggtgtgtatgcgggtgacccttcaaagctcagtatgcgggctgcatttgggaaggtatggagactggaggagaatggaggcagtattattggtggaaccatcaaggcaattcaggata

SEQ ID NO: 1333 - DNA, 200 bp, Lolium multiflorum
tatcctgaattgccttgatggttccaccaataatactgcctccattctcctccagtctccataccttcccaaatgcagcccgcatactgagctttgaagggtcacccgcatacacacctaacgttgatatcgaaatgttatattcttattatcgggatcaatgcaagaagcagagcagaacagaacagacatatactact

SEQ ID NO: 1334 - DNA, 200 bp, Lolium multiflorum
ggaaccatcaaggcaattcaggatagaggcaagaaccccaaaccaccgagggatccgtaagtggagactctacttttctatttagtcagttaactcactgttccattagactcgtattaatctgtttcaccacttttagccgacttccgacaccaaaggggcagacggtggcatctttcaggaagggtctagccatgctc

SEQ ID NO: 1335 - DNA, 200 bp, Lolium multiflorum
gagcatggctagacccttcctgaaagatgccaccgtctgcccctttggtgtcggaagtcggctaaaagtggtgaaacagattaatacgagtctaatggaacagtgagttaactgactaaatagaaaagtagagtctccacttacggatccctcggtggtttggggttcttgcctctatcctgaattgccttgatggttcc

SEQ ID NO: 1336 - DNA, 200 bp, Lolium multiflorum
tttcaggaagggtctagccatgctcccaaatgctatcgcttctaggtttgttttcatcacttgtgcacatacctaagttatgctatcagtatacgtggtgctgtatattgttcagatagaggggacagatctgttggtagacctactgtttgctgaactcaataccatatgaatatcattgcatcagcacccaaagtacc

SEQ ID NO: 1337 - DNA, 200 bp, Lolium multiflorum
ggtactttgggtgctgatgcaatgatattcatatggtattgagttcagcaaacagtaggtctaccaacagatctgtcccctctatctgaacaatatacagcaccacgtatactgatagcataacttaggtatgtgcacaagtgatgaaaacaaacctagaagcgatagcatttgggagcatggctagacccttcctgaaa

SEQ ID NO: 1338 - DNA, 200 bp, Lolium multiflorum
tcattgcatcagcacccaaagtacctgtggctcgattattatatcagccattctcgcattgttgatactaatgcatctgtgttaatctttttcatcttgcttttttggttgggacctgtactatataggaaattccacgagggatgagttatagagcatgtgtgtgtatgtccatgccccttgtactcggagatgatcat

SEQ ID NO: 1339 - DNA, 200 bp, Lolium multiflorum
atgatcatctccgagtacaaggggcatggacatacacacacatgctctataactcatccctcgtggaatttcctatatagtacaggtcccaaccaaaaaagcaagatgaaaaagattaacacagatgcattagtatcaacaatgcgagaatggctgatataataatcgagccacaggtactttgggtgctgatgcaatga

SEQ ID NO: 1340 - DNA, 200 bp, Lolium multiflorum
gccccttgtactcggagatgatcatgaattatagtaataatttcatgcttggtcttaagacgtaaccctgtcatgttttgcattccttcatttccaggttgggtagtaaagtcaaactctcgtggaagcttacgggcattacaaagtcggacaaccagggatatgtgttagcgtatgaaacaccggaaggagttgtttca

SEQ ID NO: 1341 - DNA, 200 bp, Lolium multiflorum
tgaaacaactccttccggtgtttcatacgctaacacatatccctggttgtccgactttgtaatgcccgtaagcttccacgagagtttgactttactacccaacctggaaatgaaggaatgcaaaacatgacagggttacgtcttaagaccaagcatgaaattattactataattcatgatcatctccgagtacaaggggc

SEQ ID NO: 1342 - DNA, 200 bp, Lolium multiflorum
tgaaacaccggaaggagttgtttcagtgcaggctaaaagtgttatcatgaccattccgtcatatattgctagtgaaatcttgcgcccactttcggtaagttcatgtttgcaaaattaattggtgtactactaatgttagtgttaggttcctgtagttctccatactcctgtgcagtggcggacccaggattttggcaaag

SEQ ID NO: 1343 - DNA, 200 bp, Lolium multiflorum
ctttgccaaaatcctgggtccgccactgcacaggagtatggagaactacaggaacctaacactaacattagtagtacaccaattaattttgcaaacatgaacttaccgaaagtgggcgcaagatttcactagcaatatatgacggaatggtcatgataacacttttagcctgcactgaaacaactccttccggtgtttca

SEQ ID NO: 1344 - DNA, 200 bp, Lolium multiflorum
tggcggacccaggattttggcaaagggtatgccacacaaaaaaattggcctgccttgataacgattttttcttagaatatgaagtagaagtgatgattatgaaatatgattgaaaaaatcaaataaaagtgttcttgcattataatcaaaatattaaattgcttaacacatgcacggtttgcgaggtgtcctatttttta

SEQ ID NO: 1345 - DNA, 200 bp, Lolium multiflorum
taaaaaataggacacctcgcaaaccgtgcatgtgttaagcaatttaatattttgattataatgcaagaacacttttatttgattttttcaatcatatttcataatcatcacttctacttcatattctaagaaaaaatcgttatcaaggcaggccaatttttttgtgtggcataccctttgccaaaatcctgggtccgcca

SEQ ID NO: 1346 - DNA, 200 bp, Lolium multiflorum
ggtttgcgaggtgtcctattttttaaactaatttctcaccgtaccatctgaccctaaatttctgaagtatttgaccacggaataatcgtttcagcaacactacaagataacgttagatcgtactaaataaacaaagaaatatgctgaagaaagctacaacggagcatataaaaattagtcacaatagctaaatggtttct

SEQ ID NO: 1347 - DNA, 200 bp, Lolium multiflorum
agaaaccatttagctattgtgactaatttttatatgctccgttgtagctttcttcagcatatttctttgtttatttagtacgatctaacgttatcttgtagtgttgctgaaacgattattccgtggtcaaatacttcagaaatttagggtcagatggtacggtgagaaattagtttaaaaaataggacacctcgcaaacc

SEQ ID NO: 1348 - DNA, 200 bp, Lolium multiflorum
tagtcacaatagctaaatggtttcttaattaatcaccatagctaatcatccattacgaaagtacctggacgcatgcatggtgcatggccatgtctctaggctagtttagcaattaaccggatggtcaagtgagtaccaaaaactaataaagcatgtgtccctgtacgatgcatgctcgcaggctacatgcaccggcttga

SEQ ID NO: 1349 - DNA, 200 bp, Lolium multiflorum
tcaagccggtgcatgtagcctgcgagcatgcatcgtacagggacacatgctttattagtttttggtactcacttgaccatccggttaattgctaaactagcctagagacatggccatgcaccatgcatgcgtccaggtactttcgtaatggatgattagctatggtgattaattaagaaaccatttagctattgtgacta

SEQ ID NO: 1350 - DNA, 200 bp, Lolium multiflorum
tcgcaggctacatgcaccggcttgattaaaatggccagctgattacaggcggttcatatggctgggccgctaggtatgccatggcatatgcggcataccctgtaggtccgcactgctcctgtggtaaccatgaaatagcacgctagtacactattccttaatagagttgctaatcaataattgaccgcattacgatactg

SEQ ID NO: 1351 - DNA, 200 bp, Lolium multiflorum
cagtatcgtaatgcggtcaattattgattagcaactctattaaggaatagtgtactagcgtgctatttcatggttaccacaggagcagtgcggacctacagggtatgccgcatatgccatggcatacctagcggcccagccatatgaaccgcctgtaatcagctggccattttaatcaagccggtgcatgtagcctgcga

SEQ ID NO: 1352 - DNA, 200 bp, Lolium multiflorum
aataattgaccgcattacgatactggttgcctgtaatcttagtccaaacacatgattgagcatttttgttgagagattaattgattaatgtggttaaactgttcactgatgcataggttggactatttcttcaccaatcaactctatgtttcaaataattgaaatatacatcaatagattcagaaaactgtatcttgttt

SEQ ID NO: 1353 - DNA, 200 bp, Lolium multiflorum
aaacaagatacagttttctgaatctattgatgtatatttcaattatttgaaacatagagttgattggtgaagaaatagtccaacctatgcatcagtgaacagtttaaccacattaatcaattaatctctcaacaaaaatgctcaatcatgtgtttggactaagattacaggcaaccagtatcgtaatgcggtcaattatt

SEQ ID NO: 1354 - DNA, 200 bp, Lolium multiflorum
gagcgcctcatcgagccttctgctcaggtgtgtatgcgggtgacccttcaaagctcagtatgagggctgcgtttgggaaggtatggagactggaggagaatggaggcagtattattggtggaaccatcaaggcaattcaggatagaggcaagaaccccaaaccgccgagggatccccgacttccgacaccaaaggggcag

SEQ ID NO: 1355 - DNA, 200 bp, Lolium multiflorum
ctgcccctttggtgtcggaagtcggggatccctcggcggtttggggttcttgcctctatcctgaattgccttgatggttccaccaataatactgcctccattctcctccagtctccataccttcccaaacgcagccctcatactgagctttgaagggtcacccgcatacacacctgagcagaaggctcgatgaggcgctc

SEQ ID NO: 1356 - DNA, 200 bp, Lolium multiflorum
ccgacttccgacaccaaaggggcagacggtggcatctttcaggaagggtctagccatgctcccaaatgctatcgcttctaggttgggtagtaaagtcaaactctcgtggaagcttacgggcattacaaagtcggacaaccagggatatgtgttagcgtatgaaacaccggaaggagttgtttcagtgcaggctaaaagtg

SEQ ID NO: 1357 - DNA, 200 bp, Lolium multiflorum
cacttttagcctgcactgaaacaactccttccggtgtttcatacgctaacacatatccctggttgtccgactttgtaatgcccgtaagcttccacgagagtttgactttactacccaacctagaagcgatagcatttgggagcatggctagacccttcctgaaagatgccaccgtctgcccctttggtgtcggaagtcgg

SEQ ID NO: 1358 - DNA, 200 bp, Lolium multiflorum
gttgtttcagtgcaggctaaaagtgttatcatgaccattccgtcatatattgctagtgaaatcttgcgcccactttcgagtgatgcagcagatggtctctcaaaattttattatccaccggttgctgctgtaactgtttcatatccaacagaagctattagaaagaatgcttaattgatggggagctccagggtttcggc

SEQ ID NO: 1359 - DNA, 200 bp, Lolium multiflorum
gccgaaaccctggagctccccatcaattaagcattctttctaatagcttctgttggatatgaaacagttacagcagcaaccggtggataataaaattttgagagaccatctgctgcatcactcgaaagtgggcgcaagatttcactagcaatatatgacggaatggtcatgataacacttttagcctgcactgaaacaac

SEQ ID NO: 1360 - DNA, 200 bp, Lolium multiflorum
tgatggggagctccagggtttcggccagttgcatccacgtagccaaggagttgagactttagggacaatatatagctcttctctctttccgaatcgtgctcctgctggaagagtgttacttctgaactatatcgggggtgctacaaatacagggatcgtctccaagactgagagtgacttggtggaagcagttgatcgtg

SEQ ID NO: 1361 - DNA, 200 bp, Lolium multiflorum
cacgatcaactgcttccaccaagtcactctcagtcttggagacgatccctgtatttgtagcacccccgatatagttcagaagtaacactcttccagcaggagcacgattcggaaagagagaagagctatatattgtccctaaagtctcaactccttggctacgtggatgcaactggccgaaaccctggagctccccatca

SEQ ID NO: 1362 - DNA, 200 bp, Lolium multiflorum
gacttggtggaagcagttgatcgtgacctcagaaaaatgttgataaatcctacagcaccagaccctttagccttaggcgtccgagtgtggccacaagccattccacagtttttgattgggcaccttgatcgccttgatgcggcaaaatctgccttggccagaggcggctgcagtgggttgtttctaggaggaaactatgt

SEQ ID NO: 1363 - DNA, 200 bp, Lolium multiflorum
acatagtttcctcctagaaacaacccactgcagccgcctctggccaaggcagattttgccgcatcaaggcgatcaaggtgcccaatcaaaaactgtggaatggcttgtggccacactcggacgcctaaggctaaagggtctggtgctgtaggatttatcaacatttttctgaggtcacgatcaactgcttccaccaagtc

SEQ ID NO: 1364 - DNA, 200 bp, Lolium multiflorum
ggttgtttctaggaggaaactatgtagcaggagttgccttgggccgatgcatcgagggtgcgtacgagagtgcctcagaagtatctgacttcttgaccaagtatgcctacaagtgatgaaagaagtgtaattcatcatcttgctgcatatttgaggtgcggccagaattagtaataattcggaaaatcttgtaatcttct

SEQ ID NO: 1365 - DNA, 200 bp, Lolium multiflorum
agaagattacaagattttccgaattattactaattctggccgcacctcaaatatgcagcaagatgatgaattacacttctttcatcacttgtaggcatacttggtcaagaagtcagatacttctgaggcactctcgtacgcaccctcgatgcatcggcccaaggcaactcctgctacatagtttcctcctagaaacaacc

SEQ ID NO: 1366 - DNA, 200 bp, Lolium multiflorum
ggttttggtattattctactaataattcgtggcatttttatgtagggacaatatatagctcttctctctttccaaatcgtgctcctgctggaagagtgttacttctgaactatatcggtggtgctacaaatacagggatcgtctccaaggttctctcgacctgctggatactcatgtcattttcttattgcgtgatacca

SEQ ID NO: 1367 - DNA, 200 bp, Lolium multiflorum
tggtatcacgcaataagaaaatgacatgagtatccagcaggtcgagagaaccttggagacgatccctgtatttgtagcaccaccgatatagttcagaagtaacactcttccagcaggagcacgatttggaaagagagaagagctatatattgtccctacataaaaatgccacgaattattagtagaataataccaaaacc

SEQ ID NO: 1368 - DNA, 200 bp, Lolium multiflorum
gtcattttcttattgcgtgataccaggttacagtattcagttagtgttggtcacctattcatttatgattaatataaataactggactgcatttttcacccccagctgcaattgtgaatacaaatagattaaatggtctgcttagatgctacattcaatctcaatagtattgttagattttttttttggctggccatatt

SEQ ID NO: 1369 - DNA, 200 bp, Lolium multiflorum
aatatggccagccaaaaaaaaaatctaacaatactattgagattgaatgtagcatctaagcagaccatttaatctatttgtattcacaattgcagctgggggtgaaaaatgcagtccagttatttatattaatcataaatgaataggtgaccaacactaactgaatactgtaacctggtatcacgcaataagaaaatgac

SEQ ID NO: 1370 - DNA, 200 bp, Lolium multiflorum
gattttttttttggctggccatatttatactgatcccattttgtttgcagactgagagtgacttggtggaagcagttgatcgtgacctcagaaaaatgttgataaatcctacagcaccagaccctttagccttaggtgtccgagtgtggccacaagccattccacagtttttgattgggcaccttgatcgccttgatgcg

SEQ ID NO: 1371 - DNA, 200 bp, Lolium multiflorum
cgcatcaaggcgatcaaggtgcccaatcaaaaactgtggaatggcttgtggccacactcggacacctaaggctaaagggtctggtgctgtaggatttatcaacatttttctgaggtcacgatcaactgcttccaccaagtcactctcagtctgcaaacaaaatgggatcagtataaatatggccagccaaaaaaaaaatc

SEQ ID NO: 1372 - DNA, 200 bp, Lolium multiflorum
tgggcaccttgatcgccttgatgcggcaaaatctgccttggccagaggcggctgcagtgggttgttcctaggaggaaactatgtagcaggagttgccttgggccgatgcatcgagggtgcgtacgagagtgcctcagaagtatctgacttcttgaccaagtatgcctacaagtgatgaaagaagtgtaattcatcatctt

SEQ ID NO: 1373 - DNA, 200 bp, Lolium multiflorum
aagatgatgaattacacttctttcatcacttgtaggcatacttggtcaagaagtcagatacttctgaggcactctcgtacgcaccctcgatgcatcggcccaaggcaactcctgctacatagtttcctcctaggaacaacccactgcagccgcctctggccaaggcagattttgccgcatcaaggcgatcaaggtgccca

SEQ ID NO: 1374 - DNA, 200 bp, Lolium multiflorum
tcaggggcgtgaggagtcggtggaggaatttgtgcgccgcaacctgggtgcggaggtctttgagcgcctcatcgagcctttctgctcaggtagtgtgcagtagtatctgtctgttctgttctgctctgcttcctgcattgattccgataataagaatataacatttcgatatcaacgttaggtgtgtatgcgggtgaccc

SEQ ID NO: 1375 - DNA, 200 bp, Lolium multiflorum
gggtcacccgcatacacacctaacgttgatatcgaaatgttatattcttattatcggaatcaatgcaggaagcagagcagaacagaacagacagatactactgcacactacctgagcagaaaggctcgatgaggcgctcaaagacctccgcacccaggttgcggcgcacaaattcctccaccgactcctcacgcccctga

SEQ ID NO: 1376 - DNA, 200 bp, Lolium multiflorum
cgttaggtgtgtatgcgggtgacccttcaaagctcagtatgcgggctgcgtttgggaaggtatggagactggaggagaatggaggcagtattattggtggaaccatcaaggcaattcaggatagaggcaagaaccccaaaccgccgagggatccgtaagtggagactgcaattttctatttagtcagttaactgttccat

SEQ ID NO: 1377 - DNA, 200 bp, Lolium multiflorum
atggaacagttaactgactaaatagaaaattgcagtctccacttacggatccctcggcggtttggggttcttgcctctatcctgaattgccttgatggttccaccaataatactgcctccattctcctccagtctccataccttcccaaacgcagcccgcatactgagctttgaagggtcacccgcatacacacctaacg

SEQ ID NO: 1378 - DNA, 200 bp, Lolium multiflorum
ttgaaacaacttgtgacctctgaccttagaaagctcttgggtgtagaggggcagccaacttttgtgagacatatacattggaaaaatgcttttcctctgtatggccatgattatgatttggcattggaagctataggaaagatggagaatgatcttccagggttcttctatgcaggaaataacaaggatggcttggctgt

SEQ ID NO: 1379 - DNA, 200 bp, Lolium multiflorum
acagccaagccatccttgttatttcctgcatagaagaaccctggaagatcattctccatctttcctatagcttccaatgccaaatcataatcatggccatacagaggaaaagcatttttccaatgtatatgtctcacaaaagttggctgcccctctacacccaagagctttctaaggtcagaggtcacaagttgtttcaa

SEQ ID NO: 1380 - DNA, 200 bp, Lolium multiflorum
ttgatatttattatgcaggtggattatctgccgttatccctcatggtaacagcttttaagaaggaagatgtcaaaagacccctggaaggatttggggtgttggtaccctataaggaacagcaaaaacatggtctgaaaacccttggaaccctcttctcctctatgatgttcccagatcgagctcctaatgaccaacactt

SEQ ID NO: 1381 - DNA, 200 bp, Lolium multiflorum
aagtgttggtcattaggagctcgatctgggaacatcatagaggagaagagggttccaagggttttcagaccatgtttttgctgttccttatagggtaccaacaccccaaatccttccaggggtcttttgacatcttccttcttaaaagctgttaccatgagggataacggcagataatccacctgcataataaatatcaa

SEQ ID NO: 1382 - DNA, 21 bp, Amaranthus sp., Commelina diffusa
tttgtagcacctccaatgtag

SEQ ID NO: 1383 - DNA, 21 bp, Amaranthus sp., Chenopodium album
tggctatatctgggaagaggg

SEQ ID NO: 1384 - DNA, 21 bp, Amaranthus sp., Chenopodium album
tcttcccagatatagccatcg

SEQ ID NO: 1385 - DNA, 21 bp, Amaranthus sp., Commelina diffusa
tacattggaggtgctacaaat

SEQ ID NO: 1386 - DNA, 21 bp, Amaranthus sp., Chenopodium album
gatggctatatctgggaagag

SEQ ID NO: 1387 - DNA, 21 bp, Amaranthus sp., Chenopodium album
cttcccagatatagccatcgg

SEQ ID NO: 1388 - DNA, 21 bp, Amaranthus sp., Chenopodium album
ctcttcccagatatagccatc

SEQ ID NO: 1389 - DNA, 21 bp, Amaranthus sp., Commelina diffusa
ctacattggaggtgctacaaa

SEQ ID NO: 1390 - DNA, 21 bp, Amaranthus sp., Chenopodium album
cgatggctatatctgggaaga

SEQ ID NO: 1391 - DNA, 21 bp, Amaranthus sp., Chenopodium album
cctcttcccagatatagccat

SEQ ID NO: 1392 - DNA, 21 bp, Amaranthus sp., Chenopodium album
ccgatggctatatctgggaag

SEQ ID NO: 1393 - DNA, 21 bp, Amaranthus sp., Chenopodium album
ccctcttcccagatatagcca

SEQ ID NO: 1394 - DNA, 21 bp, Amaranthus sp., Commelina diffusa
atttgtagcacctccaatgta

SEQ ID NO: 1395 - DNA, 21 bp, Amaranthus sp., Chenopodium album
atggctatatctgggaagagg

SEQ ID NO: 1396 - DNA, 21 bp, Amaranthus sp.
ttttttgatctcatgagcttt

SEQ ID NO: 1397 - DNA, 21 bp, Amaranthus sp.
tttttgatctcatgagctttc

SEQ ID NO: 1398 - DNA, 21 bp, Amaranthus sp.
ttttgctctaaggtccagacc

SEQ ID NO: 1399 - DNA, 21 bp, Amaranthus sp.
ttttgatctcatgagctttcc

SEQ ID NO: 1400 - DNA, 21 bp, Amaranthus sp.
tttggtcctaacagaaaccgg

SEQ ID NO: 1401 - DNA, 21 bp, Amaranthus sp.
tttggccatactctcactccc

SEQ ID NO: 1402 - DNA, 21 bp, Amaranthus sp.
tttggatttatcagaattttt

SEQ ID NO: 1403 - DNA, 21 bp, Amaranthus sp.
tttggaaaggtctggacctta

SEQ ID NO: 1404 - DNA, 21 bp, Amaranthus sp.
tttgctctaaggtccagacct

SEQ ID NO: 1405 - DNA, 21 bp, Amaranthus sp.
tttgatctcatgagctttcct

SEQ ID NO: 1406 - DNA, 21 bp, Amaranthus sp.
tttgagtgtaccggcgatgat

SEQ ID NO: 1407 - DNA, 21 bp, Amaranthus sp.
tttgactttactgccaagcct

SEQ ID NO: 1408 - DNA, 21 bp, Amaranthus sp.
tttctgttaggaccaaagcgg

SEQ ID NO: 1409 - DNA, 21 bp, Amaranthus sp.
tttctaatattgataagtcgc

SEQ ID NO: 1410 - DNA, 21 bp, Amaranthus sp.
tttcgcatttggatttatcag

SEQ ID NO: 1411 - DNA, 21 bp, Amaranthus sp.
tttcctggtaagattagggct

SEQ ID NO: 1412 - DNA, 21 bp, Amaranthus sp.
tttcctaaaggatccaacagt

SEQ ID NO: 1413 - DNA, 21 bp, Amaranthus sp.
tttccaaatgcagctttcata

SEQ ID NO: 1414 - DNA, 21 bp, Amaranthus sp.
tttcaatccactgtcaaccgc

SEQ ID NO: 1415 - DNA, 21 bp, Amaranthus sp.
tttatcagaatttttctgaga

SEQ ID NO: 1416 - DNA, 21 bp, Amaranthus sp.
tttaggaaggcgggggtctcg

SEQ ID NO: 1417 - DNA, 21 bp, Amaranthus sp.
tttactgccaagcctagcagc

SEQ ID NO: 1418 - DNA, 21 bp, Amaranthus sp.
ttgtagcacctccaatgtagc

SEQ ID NO: 1419 - DNA, 21 bp, Amaranthus sp.
ttggtcctaacagaaaccggt

SEQ ID NO: 1420 - DNA, 21 bp, Amaranthus sp.
ttggccatactctcactccca

SEQ ID NO: 1421 - DNA, 21 bp, Amaranthus sp.
ttggcagtaaagtcaaactat

SEQ ID NO: 1422 - DNA, 21 bp, Amaranthus sp.
ttggatttatcagaatttttc

SEQ ID NO: 1423 - DNA, 21 bp, Amaranthus sp.
ttggaaaggtctggaccttag

SEQ ID NO: 1424 - DNA, 21 bp, Amaranthus sp.
ttggaaactattaggaccctc

SEQ ID NO: 1425 - DNA, 21 bp, Amaranthus sp.
ttgctgctaggcttggcagta

SEQ ID NO: 1426 - DNA, 21 bp, Amaranthus sp.
ttgctctaaggtccagacctt

SEQ ID NO: 1427 - DNA, 21 bp, Amaranthus sp.
ttgcctttggccatactctca

SEQ ID NO: 1428 - DNA, 21 bp, Amaranthus sp.
ttgcaagtagcctgcttcgtc

SEQ ID NO: 1429 - DNA, 21 bp, Amaranthus sp.
ttgatcttgagctacattgga

SEQ ID NO: 1430 - DNA, 21 bp, Amaranthus sp.
ttgatctcatgagctttcctg

SEQ ID NO: 1431 - DNA, 21 bp, Amaranthus sp.
ttgataagtcgctcaatggtg

SEQ ID NO: 1432 - DNA, 21 bp, Amaranthus sp.
ttgagtgtaccggcgatgata

SEQ ID NO: 1433 - DNA, 21 bp, Amaranthus sp.
ttgagtatgaaagctgcattt

SEQ ID NO: 1434 - DNA, 21 bp, Amaranthus sp.
ttgagctacattggaggtgct

SEQ ID NO: 1435 - DNA, 21 bp, Amaranthus sp.
ttgagcgacttatcaatatta

SEQ ID NO: 1436 - DNA, 21 bp, Amaranthus sp.
ttgactttactgccaagccta

SEQ ID NO: 1437 - DNA, 21 bp, Amaranthus sp.
ttgaagaatttgtgcgccgta

SEQ ID NO: 1438 - DNA, 21 bp, Amaranthus sp.
ttctgttaggaccaaagcggt

SEQ ID NO: 1439 - DNA, 21 bp, Amaranthus sp.
ttctgggagtgagagtatggc

SEQ ID NO: 1440 - DNA, 21 bp, Amaranthus sp.
ttctgataaatccaaatgcga

SEQ ID NO: 1441 - DNA, 21 bp, Amaranthus sp.
ttctaatattgataagtcgct

SEQ ID NO: 1442 - DNA, 21 bp, Amaranthus sp.
ttcgcatttggatttatcaga

SEQ ID NO: 1443 - DNA, 21 bp, Amaranthus sp.
ttcctggtaagattagggctg

SEQ ID NO: 1444 - DNA, 21 bp, Amaranthus sp.
ttcctaaaggatccaacagtc

SEQ ID NO: 1445 - DNA, 21 bp, Amaranthus sp.
ttcctaaacctaagggccaga

SEQ ID NO: 1446 - DNA, 21 bp, Amaranthus sp.
ttcccttttttgatctcatga

SEQ ID NO: 1447 - DNA, 21 bp, Amaranthus sp.
ttcccagatatagccatcgga

SEQ ID NO: 1448 - DNA, 21 bp, Amaranthus sp.
ttccaaatgcagctttcatac

SEQ ID NO: 1449 - DNA, 21 bp, Amaranthus sp.
ttcatcttcactcttttgtaa

SEQ ID NO: 1450 - DNA, 21 bp, Amaranthus sp.
ttcatacattgcaagtagcct

SEQ ID NO: 1451 - DNA, 21 bp, Amaranthus sp.
ttcaggaaaggaagaataatc

SEQ ID NO: 1452 - DNA, 21 bp, Amaranthus sp.
ttcaccattgagcgacttatc

SEQ ID NO: 1453 - DNA, 21 bp, Amaranthus sp.
ttcaatccactgtcaaccgcc

SEQ ID NO: 1454 - DNA, 21 bp, Amaranthus sp.
ttattcttcctttcctgaata

SEQ ID NO: 1455 - DNA, 21 bp, Amaranthus sp.
ttatgttacctaccgccattg

SEQ ID NO: 1456 - DNA, 21 bp, Amaranthus sp.
ttatcagaatttttctgagat

SEQ ID NO: 1457 - DNA, 21 bp, Amaranthus sp.
ttatcaatattagaaagtgtc

SEQ ID NO: 1458 - DNA, 21 bp, Amaranthus sp.
ttaggtttaggaaggcggggg

SEQ ID NO: 1459 - DNA, 21 bp, Amaranthus sp.
ttaggaccctcttcccagata

SEQ ID NO: 1460 - DNA, 21 bp, Amaranthus sp.
ttaggaccaaagcggttgtca

SEQ ID NO: 1461 - DNA, 21 bp, Amaranthus sp.
ttaggaaggcgggggtctcga

SEQ ID NO: 1462 - DNA, 21 bp, Amaranthus sp.
ttagagcaaaagggtggtagt

SEQ ID NO: 1463 - DNA, 21 bp, Amaranthus sp.
ttactgccaagcctagcagca

SEQ ID NO: 1464 - DNA, 21 bp, Amaranthus sp.
ttactatggcggttgacagtg

SEQ ID NO: 1465 - DNA, 21 bp, Amaranthus sp.
ttacggcgcacaaattcttca

SEQ ID NO: 1466 - DNA, 21 bp, Amaranthus sp.
ttacctaccgccattgctgct

SEQ ID NO: 1467 - DNA, 21 bp, Amaranthus sp.
ttaccaggaaagctcatgaga

SEQ ID NO: 1468 - DNA, 21 bp, Amaranthus sp.
ttacaaaagagtgaagatgaa

SEQ ID NO: 1469 - DNA, 21 bp, Amaranthus sp.
tgttggatcctttaggaaagg

SEQ ID NO: 1470 - DNA, 21 bp, Amaranthus sp.
tgttaggaccaaagcggttgt

SEQ ID NO: 1471 - DNA, 21 bp, Amaranthus sp.
tgttacctaccgccattgctg

SEQ ID NO: 1472 - DNA, 21 bp, Amaranthus sp.
tgtgcttactatggcggttga

SEQ ID NO: 1473 - DNA, 21 bp, Amaranthus sp.
tgtcaaccgccatagtaagca

SEQ ID NO: 1474 - DNA, 21 bp, Amaranthus sp.
tgtattcaccattgagcgact

SEQ ID NO: 1475 - DNA, 21 bp, Amaranthus sp.
tgtagctcaagatcaaggtcc

SEQ ID NO: 1476 - DNA, 21 bp, Amaranthus sp.
tgtagcacctccaatgtagct

SEQ ID NO: 1477 - DNA, 21 bp, Amaranthus sp.
tgtaccggcgatgatactacc

SEQ ID NO: 1478 - DNA, 21 bp, Amaranthus sp.
tggtcctaacagaaaccggtc

SEQ ID NO: 1479 - DNA, 21 bp, Amaranthus sp.
tggtagtatcatcgccggtac

SEQ ID NO: 1480 - DNA, 21 bp, Amaranthus sp.
tggtaagattagggctggtct

SEQ ID NO: 1481 - DNA, 21 bp, Amaranthus sp.
tggtaaattaaggcctgttcc

SEQ ID NO: 1482 - DNA, 21 bp, Amaranthus sp.
tgggagtgagagtatggccaa

SEQ ID NO: 1483 - DNA, 21 bp, Amaranthus sp.
tgggaagagggtcctaatagt

SEQ ID NO: 1484 - DNA, 21 bp, Amaranthus sp.
tggcggttgacagtggattga

SEQ ID NO: 1485 - DNA, 21 bp, Amaranthus sp.
tggcggtaggtaacataatga

SEQ ID NO: 1486 - DNA, 21 bp, Amaranthus sp.
tggcccttaggtttaggaagg

SEQ ID NO: 1487 - DNA, 21 bp, Amaranthus sp.
tggccatactctcactcccag

SEQ ID NO: 1488 - DNA, 21 bp, Amaranthus sp.
tggcagtaaagtcaaactatc

SEQ ID NO: 1489 - DNA, 21 bp, Amaranthus sp.
tggatttatcagaatttttct

SEQ ID NO: 1490 - DNA, 21 bp, Amaranthus sp.
tggagtccgatggctatatct

SEQ ID NO: 1491 - DNA, 21 bp, Amaranthus sp.
tggaggattattcttcctttc

SEQ ID NO: 1492 - DNA, 21 bp, Amaranthus sp.
tggaccttagagcaaaagggt

SEQ ID NO: 1493 - DNA, 21 bp, Amaranthus sp.
tggaccggtttctgttaggac

SEQ ID NO: 1494 - DNA, 21 bp, Amaranthus sp.
tggacactttctaatattgat

SEQ ID NO: 1495 - DNA, 21 bp, Amaranthus sp.
tggaatggtaaattaaggcct

SEQ ID NO: 1496 - DNA, 21 bp, Amaranthus sp.
tggaaaggtctggaccttaga

SEQ ID NO: 1497 - DNA, 21 bp, Amaranthus sp.
tggaaactattaggaccctct

SEQ ID NO: 1498 - DNA, 21 bp, Amaranthus sp.
tgcttactatggcggttgaca

SEQ ID NO: 1499 - DNA, 21 bp, Amaranthus sp.
tgctgctaggcttggcagtaa

SEQ ID NO: 1500 - DNA, 21 bp, Amaranthus sp.
tgctctaaggtccagaccttt

SEQ ID NO: 1501 - DNA, 21 bp, Amaranthus sp.
tgctaggcttggcagtaaagt

SEQ ID NO: 1502 - DNA, 21 bp, Amaranthus sp.
tgcctttggccatactctcac

SEQ ID NO: 1503 - DNA, 21 bp, Amaranthus sp.
tgcctttcgcatttggattta

SEQ ID NO: 1504 - DNA, 21 bp, Amaranthus sp.
tgccaagcctagcagcaatgg

SEQ ID NO: 1505 - DNA, 21 bp, Amaranthus sp.
tgcatttggaaaggtctggac

SEQ ID NO: 1506 - DNA, 21 bp, Amaranthus sp.
tgcagctttcatactcaactt

SEQ ID NO: 1507 - DNA, 21 bp, Amaranthus sp.
tgcaagtagcctgcttcgtcc

SEQ ID NO: 1508 - DNA, 21 bp, Amaranthus sp.
tgatcttgagctacattggag

SEQ ID NO: 1509 - DNA, 21 bp, Amaranthus sp.
tgatctcatgagctttcctgg

SEQ ID NO: 1510 - DNA, 21 bp, Amaranthus sp.
tgatactaccacccttttgct

SEQ ID NO: 1511 - DNA, 21 bp, Amaranthus sp.
tgataagtcgctcaatggtga

SEQ ID NO: 1512 - DNA, 21 bp, Amaranthus sp.
tgataaatccaaatgcgaaag

SEQ ID NO: 1513 - DNA, 21 bp, Amaranthus sp.
tgagtgtaccggcgatgatac

SEQ ID NO: 1514 - DNA, 21 bp, Amaranthus sp.
tgagtatgaaagctgcatttg

SEQ ID NO: 1515 - DNA, 21 bp, Amaranthus sp.
tgagctttcctggtaagatta

SEQ ID NO: 1516 - DNA, 21 bp, Amaranthus sp.
tgagctacattggaggtgcta

SEQ ID NO: 1517 - DNA, 21 bp, Amaranthus sp.
tgagcgacttatcaatattag

SEQ ID NO: 1518 - DNA, 21 bp, Amaranthus sp.
tgagatcaaaaaagggaaggt

SEQ ID NO: 1519 - DNA, 21 bp, Amaranthus sp.
tgagagtatggccaaaggcaa

SEQ ID NO: 1520 - DNA, 21 bp, Amaranthus sp.
tgactttactgccaagcctag

SEQ ID NO: 1521 - DNA, 21 bp, Amaranthus sp.
tgacaaccgctttggtcctaa

SEQ ID NO: 1522 - DNA, 21 bp, Amaranthus sp.
tgaagaatttgtgcgccgtaa

SEQ ID NO: 1523 - DNA, 21 bp, Amaranthus sp.
tgaaagctgcatttggaaagg

SEQ ID NO: 1524 - DNA, 21 bp, Amaranthus sp.
tctttcaatccactgtcaacc

SEQ ID NO: 1525 - DNA, 21 bp, Amaranthus sp.
tcttgagctacattggaggtg

SEQ ID NO: 1526 - DNA, 21 bp, Amaranthus sp.
tcttaccaggaaagctcatga

SEQ ID NO: 1527 - DNA, 21 bp, Amaranthus sp.
tctgttaggaccaaagcggtt

SEQ ID NO: 1528 - DNA, 21 bp, Amaranthus sp.
tctgggagtgagagtatggcc

SEQ ID NO: 1529 - DNA, 21 bp, Amaranthus sp.
tctgggaagagggtcctaata

SEQ ID NO: 1530 - DNA, 21 bp, Amaranthus sp.
tctggcccttaggtttaggaa

SEQ ID NO: 1531 - DNA, 21 bp, Amaranthus sp.
tctggaccttagagcaaaagg

SEQ ID NO: 1532 - DNA, 21 bp, Amaranthus sp.
tctgataaatccaaatgcgaa

SEQ ID NO: 1533 - DNA, 21 bp, Amaranthus sp.
tctcatgagctttcctggtaa

SEQ ID NO: 1534 - DNA, 21 bp, Amaranthus sp.
tctcagaaaaattctgataaa

SEQ ID NO: 1535 - DNA, 21 bp, Amaranthus sp.
tctaatattgataagtcgctc

SEQ ID NO: 1536 - DNA, 21 bp, Amaranthus sp.
tctaaggtccagacctttcca

SEQ ID NO: 1537 - DNA, 21 bp, Amaranthus sp.
tcgcatttggatttatcagaa

SEQ ID NO: 1538 - DNA, 21 bp, Amaranthus sp.
tcgagacccccgccttcctaa

SEQ ID NO: 1539 - DNA, 21 bp, Amaranthus sp.
tcctgtgcttactatggcggt

SEQ ID NO: 1540 - DNA, 21 bp, Amaranthus sp.
tcctggtaagattagggctgg

SEQ ID NO: 1541 - DNA, 21 bp, Amaranthus sp.
tcctaatagtttccaaccctc

SEQ ID NO: 1542 - DNA, 21 bp, Amaranthus sp.
tcctaacagaaaccggtccat

SEQ ID NO: 1543 - DNA, 21 bp, Amaranthus sp.
tcctaaaggatccaacagtct

SEQ ID NO: 1544 - DNA, 21 bp, Amaranthus sp.
tcctaaacctaagggccagac

SEQ ID NO: 1545 - DNA, 21 bp, Amaranthus sp.
tccgcaagttcatcttcactc

SEQ ID NO: 1546 - DNA, 21 bp, Amaranthus sp.
tccgatggctatatctgggaa

SEQ ID NO: 1547 - DNA, 21 bp, Amaranthus sp.
tcccttttttgatctcatgag

SEQ ID NO: 1548 - DNA, 21 bp, Amaranthus sp.
tcccagatatagccatcggac

SEQ ID NO: 1549 - DNA, 21 bp, Amaranthus sp.
tccagacctttccaaatgcag

SEQ ID NO: 1550 - DNA, 21 bp, Amaranthus sp.
tccactgtcaaccgccatagt

SEQ ID NO: 1551 - DNA, 21 bp, Amaranthus sp.
tccaatgtagctcaagatcaa

SEQ ID NO: 1552 - DNA, 21 bp, Amaranthus sp.
tccaacagtctggcccttagg

SEQ ID NO: 1553 - DNA, 21 bp, Amaranthus sp.
tccaaatgcgaaaggcagccg

SEQ ID NO: 1554 - DNA, 21 bp, Amaranthus sp.
tccaaatgcagctttcatact

SEQ ID NO: 1555 - DNA, 21 bp, Amaranthus sp.
tcattatgttacctaccgcca

SEQ ID NO: 1556 - DNA, 21 bp, Amaranthus sp.
tcatgagctttcctggtaaga

SEQ ID NO: 1557 - DNA, 21 bp, Amaranthus sp.
tcatgagatcaaaaaagggaa

SEQ ID NO: 1558 - DNA, 21 bp, Amaranthus sp.
tcatgacaaccgctttggtcc

SEQ ID NO: 1559 - DNA, 21 bp, Amaranthus sp.
tcatcttcactcttttgtaat

SEQ ID NO: 1560 - DNA, 21 bp, Amaranthus sp.
tcatacattgcaagtagcctg

SEQ ID NO: 1561 - DNA, 21 bp, Amaranthus sp.
tcaggaaaggaagaataatcc

SEQ ID NO: 1562 - DNA, 21 bp, Amaranthus sp.
tcagaatttttctgagatcct

SEQ ID NO: 1563 - DNA, 21 bp, Amaranthus sp.
tcagaaaaattctgataaatc

SEQ ID NO: 1564 - DNA, 21 bp, Amaranthus sp.
tcaccattgagcgacttatca

SEQ ID NO: 1565 - DNA, 21 bp, Amaranthus sp.
tcaatccactgtcaaccgcca

SEQ ID NO: 1566 - DNA, 21 bp, Amaranthus sp.
tcaaccgccatagtaagcaca

SEQ ID NO: 1567 - DNA, 21 bp, Amaranthus sp.
tcaaacacccgatggaccggt

SEQ ID NO: 1568 - DNA, 21 bp, Amaranthus sp.
tcaaaaaagggaaggtccgta

SEQ ID NO: 1569 - DNA, 21 bp, Amaranthus sp.
tattgataagtcgctcaatgg

SEQ ID NO: 1570 - DNA, 21 bp, Amaranthus sp.
tattcttcctttcctgaatag

SEQ ID NO: 1571 - DNA, 21 bp, Amaranthus sp.
tattcaggaaaggaagaataa

SEQ ID NO: 1572 - DNA, 21 bp, Amaranthus sp.
tattcaccattgagcgactta

SEQ ID NO: 1573 - DNA, 21 bp, Amaranthus sp.
tattaggaccctcttcccaga

SEQ ID NO: 1574 - DNA, 21 bp, Amaranthus sp.
tattacaaaagagtgaagatg

SEQ ID NO: 1575 - DNA, 21 bp, Amaranthus sp.
tatgttacctaccgccattgc

SEQ ID NO: 1576 - DNA, 21 bp, Amaranthus sp.
tatggcggttgacagtggatt

SEQ ID NO: 1577 - DNA, 21 bp, Amaranthus sp.
tatgaaagctgcatttggaaa

SEQ ID NO: 1578 - DNA, 21 bp, Amaranthus sp.
tatctgggaagagggtcctaa

SEQ ID NO: 1579 - DNA, 21 bp, Amaranthus sp.
tatcatcgccggtacactcaa

SEQ ID NO: 1580 - DNA, 21 bp, Amaranthus sp.
tatcagaatttttctgagatc

SEQ ID NO: 1581 - DNA, 21 bp, Amaranthus sp.
tatcaatattagaaagtgtcc

SEQ ID NO: 1582 - DNA, 21 bp, Amaranthus sp.
tatcaaacacccgatggaccg

SEQ ID NO: 1583 - DNA, 21 bp, Amaranthus sp.
tatatctgggaagagggtcct

SEQ ID NO: 1584 - DNA, 21 bp, Amaranthus sp.
tatagccatcggactccatgg

SEQ ID NO: 1585 - DNA, 21 bp, Amaranthus sp.
tagtttgactttactgccaag

SEQ ID NO: 1586 - DNA, 21 bp, Amaranthus sp.
tagtatcatcgccggtacact

SEQ ID NO: 1587 - DNA, 21 bp, Amaranthus sp.
taggtttaggaaggcgggggt

SEQ ID NO: 1588 - DNA, 21 bp, Amaranthus sp.
taggcttggcagtaaagtcaa

SEQ ID NO: 1589 - DNA, 21 bp, Amaranthus sp.
taggaccttgatcttgagcta

SEQ ID NO: 1590 - DNA, 21 bp, Amaranthus sp.
taggaccctcttcccagatat

SEQ ID NO: 1591 - DNA, 21 bp, Amaranthus sp.
taggaccaaagcggttgtcat

SEQ ID NO: 1592 - DNA, 21 bp, Amaranthus sp.
taggaaggcgggggtctcgag

SEQ ID NO: 1593 - DNA, 21 bp, Amaranthus sp.
tagctcaagatcaaggtccta

SEQ ID NO: 1594 - DNA, 21 bp, Amaranthus sp.
tagccatcggactccatggta

SEQ ID NO: 1595 - DNA, 21 bp, Amaranthus sp.
tagcagcaatggcggtaggta

SEQ ID NO: 1596 - DNA, 21 bp, Amaranthus sp.
tagcacctccaatgtagctca

SEQ ID NO: 1597 - DNA, 21 bp, Amaranthus sp.
tagagcaaaagggtggtagta

SEQ ID NO: 1598 - DNA, 21 bp, Amaranthus sp.
tactgccaagcctagcagcaa

SEQ ID NO: 1599 - DNA, 21 bp, Amaranthus sp.
tactatggcggttgacagtgg

SEQ ID NO: 1600 - DNA, 21 bp, Amaranthus sp.
tactaccacccttttgctcta

SEQ ID NO: 1601 - DNA, 21 bp, Amaranthus sp.
tacggcgcacaaattcttcaa

SEQ ID NO: 1602 - DNA, 21 bp, Amaranthus sp.
tacggaccttcccttttttga

SEQ ID NO: 1603 - DNA, 21 bp, Amaranthus sp.
tacctaccgccattgctgcta

SEQ ID NO: 1604 - DNA, 21 bp, Amaranthus sp.
taccggcgatgatactaccac

SEQ ID NO: 1605 - DNA, 21 bp, Amaranthus sp.
taccgccattgctgctaggct

SEQ ID NO: 1606 - DNA, 21 bp, Amaranthus sp.
taccatggagtccgatggcta

SEQ ID NO: 1607 - DNA, 21 bp, Amaranthus sp.
taccaggaaagctcatgagat

SEQ ID NO: 1608 - DNA, 21 bp, Amaranthus sp.
taccacccttttgctctaagg

SEQ ID NO: 1609 - DNA, 21 bp, Amaranthus sp.
tacattgcaagtagcctgctt

SEQ ID NO: 1610 - DNA, 21 bp, Amaranthus sp.
tacaaaagagtgaagatgaac

SEQ ID NO: 1611 - DNA, 21 bp, Amaranthus sp.
taatcttaccaggaaagctca

SEQ ID NO: 1612 - DNA, 21 bp, Amaranthus sp.
taatattgataagtcgctcaa

SEQ ID NO: 1613 - DNA, 21 bp, Amaranthus sp.
taagtcgctcaatggtgaata

SEQ ID NO: 1614 - DNA, 21 bp, Amaranthus sp.
taaggtccagacctttccaaa

SEQ ID NO: 1615 - DNA, 21 bp, Amaranthus sp.
taagggccagactgttggatc

SEQ ID NO: 1616 - DNA, 21 bp, Amaranthus sp.
taagattagggctggtcttgg

SEQ ID NO: 1617 - DNA, 21 bp, Amaranthus sp.
taacagaaaccggtccatcgg

SEQ ID NO: 1618 - DNA, 21 bp, Amaranthus sp.
taaattaaggcctgttccttc

SEQ ID NO: 1619 - DNA, 21 bp, Amaranthus sp.
taaatccaaatgcgaaaggca

SEQ ID NO: 1620 - DNA, 21 bp, Amaranthus sp.
taaaggatccaacagtctggc

SEQ ID NO: 1621 - DNA, 21 bp, Amaranthus sp.
taaacctaagggccagactgt

SEQ ID NO: 1622 - DNA, 21 bp, Amaranthus sp.
gtttgactttactgccaagcc

SEQ ID NO: 1623 - DNA, 21 bp, Amaranthus sp.
gtttctgttaggaccaaagcg

SEQ ID NO: 1624 - DNA, 21 bp, Amaranthus sp.
gtttaggaaggcgggggtctc

SEQ ID NO: 1625 - DNA, 21 bp, Amaranthus sp.
gttggaaactattaggaccct

SEQ ID NO: 1626 - DNA, 21 bp, Amaranthus sp.
gttgagtatgaaagctgcatt

SEQ ID NO: 1627 - DNA, 21 bp, Amaranthus sp.
gttgaagaatttgtgcgccgt

SEQ ID NO: 1628 - DNA, 21 bp, Amaranthus sp.
gttctgggagtgagagtatgg

SEQ ID NO: 1629 - DNA, 21 bp, Amaranthus sp.
gttcatcttcactcttttgta

SEQ ID NO: 1630 - DNA, 21 bp, Amaranthus sp.
gttaggaccaaagcggttgtc

SEQ ID NO: 1631 - DNA, 21 bp, Amaranthus sp.
gttacctaccgccattgctgc

SEQ ID NO: 1632 - DNA, 21 bp, Amaranthus sp.
gtgtaccggcgatgatactac

SEQ ID NO: 1633 - DNA, 21 bp, Amaranthus sp.
gtggtagtatcatcgccggta

SEQ ID NO: 1634 - DNA, 21 bp, Amaranthus sp.
gtggaggattattcttccttt

SEQ ID NO: 1635 - DNA, 21 bp, Amaranthus sp.
gtgcttactatggcggttgac

SEQ ID NO: 1636 - DNA, 21 bp, Amaranthus sp.
gtgagagtatggccaaaggca

SEQ ID NO: 1637 - DNA, 21 bp, Amaranthus sp.
gtctggcccttaggtttagga

SEQ ID NO: 1638 - DNA, 21 bp, Amaranthus sp.
gtctggaccttagagcaaaag

SEQ ID NO: 1639 - DNA, 21 bp, Amaranthus sp.
gtcctaatagtttccaaccct

SEQ ID NO: 1640 - DNA, 21 bp, Amaranthus sp.
gtcctaacagaaaccggtcca

SEQ ID NO: 1641 - DNA, 21 bp, Amaranthus sp.
gtccgatggctatatctggga

SEQ ID NO: 1642 - DNA, 21 bp, Amaranthus sp.
gtccagacctttccaaatgca

SEQ ID NO: 1643 - DNA, 21 bp, Amaranthus sp.
gtcatgacaaccgctttggtc

SEQ ID NO: 1644 - DNA, 21 bp, Amaranthus sp.
gtcaaccgccatagtaagcac

SEQ ID NO: 1645 - DNA, 21 bp, Amaranthus sp.
gtattcaccattgagcgactt

SEQ ID NO: 1646 - DNA, 21 bp, Amaranthus sp.
gtatgaaagctgcatttggaa

SEQ ID NO: 1647 - DNA, 21 bp, Amaranthus sp.
gtatcatcgccggtacactca

SEQ ID NO: 1648 - DNA, 21 bp, Amaranthus sp.
gtagtatcatcgccggtacac

SEQ ID NO: 1649 - DNA, 21 bp, Amaranthus sp.
gtagctcaagatcaaggtcct

SEQ ID NO: 1650 - DNA, 21 bp, Amaranthus sp.
gtagcacctccaatgtagctc

SEQ ID NO: 1651 - DNA, 21 bp, Amaranthus sp.
gtaccggcgatgatactacca

SEQ ID NO: 1652 - DNA, 21 bp, Amaranthus sp.
gtaagattagggctggtcttg

SEQ ID NO: 1653 - DNA, 21 bp, Amaranthus sp.
gtaaattaaggcctgttcctt

SEQ ID NO: 1654 - DNA, 21 bp, Amaranthus sp.
ggtttctgttaggaccaaagc

SEQ ID NO: 1655 - DNA, 21 bp, Amaranthus sp.
ggtttaggaaggcgggggtct

SEQ ID NO: 1656 - DNA, 21 bp, Amaranthus sp.
ggttggaaactattaggaccc

SEQ ID NO: 1657 - DNA, 21 bp, Amaranthus sp.
ggttgacagtggattgaaaga

SEQ ID NO: 1658 - DNA, 21 bp, Amaranthus sp.
ggtggtagtatcatcgccggt

SEQ ID NO: 1659 - DNA, 21 bp, Amaranthus sp.
ggtggaggattattcttcctt

SEQ ID NO: 1660 - DNA, 21 bp, Amaranthus sp.
ggtctggaccttagagcaaaa

SEQ ID NO: 1661 - DNA, 21 bp, Amaranthus sp.
ggtcctaatagtttccaaccc

SEQ ID NO: 1662 - DNA, 21 bp, Amaranthus sp.
ggtcctaacagaaaccggtcc

SEQ ID NO: 1663 - DNA, 21 bp, Amaranthus sp.
ggtccagacctttccaaatgc

SEQ ID NO: 1664 - DNA, 21 bp, Amaranthus sp.
ggtagtatcatcgccggtaca

SEQ ID NO: 1665 - DNA, 21 bp, Amaranthus sp.
ggtaagattagggctggtctt

SEQ ID NO: 1666 - DNA, 21 bp, Amaranthus sp.
ggtaaattaaggcctgttcct

SEQ ID NO: 1667 - DNA, 21 bp, Amaranthus sp.
gggttggaaactattaggacc

SEQ ID NO: 1668 - DNA, 21 bp, Amaranthus sp.
gggtggtagtatcatcgccgg

SEQ ID NO: 1669 - DNA, 21 bp, Amaranthus sp.
gggtcctaatagtttccaacc

SEQ ID NO: 1670 - DNA, 21 bp, Amaranthus sp.
gggccagactgttggatcctt

SEQ ID NO: 1671 - DNA, 21 bp, Amaranthus sp.
gggagtgagagtatggccaaa

SEQ ID NO: 1672 - DNA, 21 bp, Amaranthus sp.
gggaagagggtcctaatagtt

SEQ ID NO: 1673 - DNA, 21 bp, Amaranthus sp.
ggcttggcagtaaagtcaaac

SEQ ID NO: 1674 - DNA, 21 bp, Amaranthus sp.
ggctgcctttcgcatttggat

SEQ ID NO: 1675 - DNA, 21 bp, Amaranthus sp.
ggctatatctgggaagagggt

SEQ ID NO: 1676 - DNA, 21 bp, Amaranthus sp.
ggctacttgcaatgtatgaag

SEQ ID NO: 1677 - DNA, 21 bp, Amaranthus sp.
ggcggttgacagtggattgaa

SEQ ID NO: 1678 - DNA, 21 bp, Amaranthus sp.
ggcggtaggtaacataatgag

SEQ ID NO: 1679 - DNA, 21 bp, Amaranthus sp.
ggcgatgatactaccaccctt

SEQ ID NO: 1680 - DNA, 21 bp, Amaranthus sp.
ggcccttaggtttaggaaggc

SEQ ID NO: 1681 - DNA, 21 bp, Amaranthus sp.
ggccatactctcactcccaga

SEQ ID NO: 1682 - DNA, 21 bp, Amaranthus sp.
ggccagactgttggatccttt

SEQ ID NO: 1683 - DNA, 21 bp, Amaranthus sp.
ggatttatcagaatttttctg

SEQ ID NO: 1684 - DNA, 21 bp, Amaranthus sp.
ggattattcttcctttcctga

SEQ ID NO: 1685 - DNA, 21 bp, Amaranthus sp.
ggatctcagaaaaattctgat

SEQ ID NO: 1686 - DNA, 21 bp, Amaranthus sp.
ggatccaacagtctggccctt

SEQ ID NO: 1687 - DNA, 21 bp, Amaranthus sp.
ggagtgagagtatggccaaag

SEQ ID NO: 1688 - DNA, 21 bp, Amaranthus sp.
ggagtccgatggctatatctg

SEQ ID NO: 1689 - DNA, 21 bp, Amaranthus sp.
ggaggattattcttcctttcc

SEQ ID NO: 1690 - DNA, 21 bp, Amaranthus sp.
ggacgaagcaggctacttgca

SEQ ID NO: 1691 - DNA, 21 bp, Amaranthus sp.
ggaccttgatcttgagctaca

SEQ ID NO: 1692 - DNA, 21 bp, Amaranthus sp.
ggaccttcccttttttgatct

SEQ ID NO: 1693 - DNA, 21 bp, Amaranthus sp.
ggaccttagagcaaaagggtg

SEQ ID NO: 1694 - DNA, 21 bp, Amaranthus sp.
ggaccggtttctgttaggacc

SEQ ID NO: 1695 - DNA, 21 bp, Amaranthus sp.
ggaccctcttcccagatatag

SEQ ID NO: 1696 - DNA, 21 bp, Amaranthus sp.
ggaccaaagcggttgtcatga

SEQ ID NO: 1697 - DNA, 21 bp, Amaranthus sp.
ggacactttctaatattgata

SEQ ID NO: 1698 - DNA, 21 bp, Amaranthus sp.
ggaatggtaaattaaggcctg

SEQ ID NO: 1699 - DNA, 21 bp, Amaranthus sp.
ggaagagggtcctaatagttt

SEQ ID NO: 1700 - DNA, 21 bp, Amaranthus sp.
ggaacaggccttaatttacca

SEQ ID NO: 1701 - DNA, 21 bp, Amaranthus sp.
ggaaaggtctggaccttagag

SEQ ID NO: 1702 - DNA, 21 bp, Amaranthus sp.
ggaaaggaagaataatcctcc

SEQ ID NO: 1703 - DNA, 21 bp, Amaranthus sp.
ggaaagctcatgagatcaaaa

SEQ ID NO: 1704 - DNA, 21 bp, Amaranthus sp.
ggaaactattaggaccctctt

SEQ ID NO: 1705 - DNA, 21 bp, Amaranthus sp.
gctttggtcctaacagaaacc

SEQ ID NO: 1706 - DNA, 21 bp, Amaranthus sp.
gctttcctggtaagattaggg

SEQ ID NO: 1707 - DNA, 21 bp, Amaranthus sp.
gcttggcagtaaagtcaaact

SEQ ID NO: 1708 - DNA, 21 bp, Amaranthus sp.
gcttactatggcggttgacag

SEQ ID NO: 1709 - DNA, 21 bp, Amaranthus sp.
gctgctaggcttggcagtaaa

SEQ ID NO: 1710 - DNA, 21 bp, Amaranthus sp.
gctgcctttcgcatttggatt

SEQ ID NO: 1711 - DNA, 21 bp, Amaranthus sp.
gctgcatttggaaaggtctgg

SEQ ID NO: 1712 - DNA, 21 bp, Amaranthus sp.
gctctaaggtccagacctttc

SEQ ID NO: 1713 - DNA, 21 bp, Amaranthus sp.
gctcatgagatcaaaaaaggg

SEQ ID NO: 1714 - DNA, 21 bp, Amaranthus sp.
gctatatctgggaagagggtc

SEQ ID NO: 1715 - DNA, 21 bp, Amaranthus sp.
gctaggcttggcagtaaagtc

SEQ ID NO: 1716 - DNA, 21 bp, Amaranthus sp.
gctacttgcaatgtatgaagg

SEQ ID NO: 1717 - DNA, 21 bp, Amaranthus sp.
gctacattggaggtgctacaa

SEQ ID NO: 1718 - DNA, 21 bp, Amaranthus sp.
gcggttgacagtggattgaaa

SEQ ID NO: 1719 - DNA, 21 bp, Amaranthus sp.
gcgatgatactaccacccttt

SEQ ID NO: 1720 - DNA, 21 bp, Amaranthus sp.
gcgacttatcaatattagaaa

SEQ ID NO: 1721 - DNA, 21 bp, Amaranthus sp.
gcctttggccatactctcact

SEQ ID NO: 1722 - DNA, 21 bp, Amaranthus sp.
gcctttcgcatttggatttat

SEQ ID NO: 1723 - DNA, 21 bp, Amaranthus sp.
gccttcctaaacctaagggcc

SEQ ID NO: 1724 - DNA, 21 bp, Amaranthus sp.
gcctagcagcaatggcggtag

SEQ ID NO: 1725 - DNA, 21 bp, Amaranthus sp.
gcccttaggtttaggaaggcg

SEQ ID NO: 1726 - DNA, 21 bp, Amaranthus sp.
gccctaatcttaccaggaaag

SEQ ID NO: 1727 - DNA, 21 bp, Amaranthus sp.
gccattgctgctaggcttggc

SEQ ID NO: 1728 - DNA, 21 bp, Amaranthus sp.
gccatcggactccatggtagt

SEQ ID NO: 1729 - DNA, 21 bp, Amaranthus sp.
gccatactctcactcccagaa

SEQ ID NO: 1730 - DNA, 21 bp, Amaranthus sp.
gccagactgttggatccttta

SEQ ID NO: 1731 - DNA, 21 bp, Amaranthus sp.
gccaagcctagcagcaatggc

SEQ ID NO: 1732 - DNA, 21 bp, Amaranthus sp.
gcatttggatttatcagaatt

SEQ ID NO: 1733 - DNA, 21 bp, Amaranthus sp.
gcatttggaaaggtctggacc

SEQ ID NO: 1734 - DNA, 21 bp, Amaranthus sp.
gcaggctacttgcaatgtatg

SEQ ID NO: 1735 - DNA, 21 bp, Amaranthus sp.
gcagctttcatactcaacttt

SEQ ID NO: 1736 - DNA, 21 bp, Amaranthus sp.
gcagcaatggcggtaggtaac

SEQ ID NO: 1737 - DNA, 21 bp, Amaranthus sp.
gcacctccaatgtagctcaag

SEQ ID NO: 1738 - DNA, 21 bp, Amaranthus sp.
gcaccaagaccagccctaatc

SEQ ID NO: 1739 - DNA, 21 bp, Amaranthus sp.
gcaatggcggtaggtaacata

SEQ ID NO: 1740 - DNA, 21 bp, Amaranthus sp.
gcaagttcatcttcactcttt

SEQ ID NO: 1741 - DNA, 21 bp, Amaranthus sp.
gcaaaagggtggtagtatcat

SEQ ID NO: 1742 - DNA, 21 bp, Amaranthus sp.
gatttatcagaatttttctga

SEQ ID NO: 1743 - DNA, 21 bp, Amaranthus sp.
gattattcttcctttcctgaa

SEQ ID NO: 1744 - DNA, 21 bp, Amaranthus sp.
gattagggctggtcttggtgc

SEQ ID NO: 1745 - DNA, 21 bp, Amaranthus sp.
gattacggcgcacaaattctt

SEQ ID NO: 1746 - DNA, 21 bp, Amaranthus sp.
gatgttgctgcagattctctt

SEQ ID NO: 1747 - DNA, 21 bp, Amaranthus sp.
gatggaccggtttctgttagg

SEQ ID NO: 1748 - DNA, 21 bp, Amaranthus sp.
gatgatactaccacccttttg

SEQ ID NO: 1749 - DNA, 21 bp, Amaranthus sp.
gatcttgagctacattggagg

SEQ ID NO: 1750 - DNA, 21 bp, Amaranthus sp.
gatctcatgagctttcctggt

SEQ ID NO: 1751 - DNA, 21 bp, Amaranthus sp.
gatctcagaaaaattctgata

SEQ ID NO: 1752 - DNA, 21 bp, Amaranthus sp.
gatcctgtgcttactatggcg

SEQ ID NO: 1753 - DNA, 21 bp, Amaranthus sp.
gatccaacagtctggccctta

SEQ ID NO: 1754 - DNA, 21 bp, Amaranthus sp.
gatcaaaaaagggaaggtccg

SEQ ID NO: 1755 - DNA, 21 bp, Amaranthus sp.
gatatagccatcggactccat

SEQ ID NO: 1756 - DNA, 21 bp, Amaranthus sp.
gatagtttgactttactgcca

SEQ ID NO: 1757 - DNA, 21 bp, Amaranthus sp.
gatactaccacccttttgctc

SEQ ID NO: 1758 - DNA, 21 bp, Amaranthus sp.
gataagtcgctcaatggtgaa

SEQ ID NO: 1759 - DNA, 21 bp, Amaranthus sp.
gataaatccaaatgcgaaagg

SEQ ID NO: 1760 - DNA, 21 bp, Amaranthus sp.
gagtgtaccggcgatgatact

SEQ ID NO: 1761 - DNA, 21 bp, Amaranthus sp.
gagtgagagtatggccaaagg

SEQ ID NO: 1762 - DNA, 21 bp, Amaranthus sp.
gagtgaagatgaacttgcgga

SEQ ID NO: 1763 - DNA, 21 bp, Amaranthus sp.
gagtccgatggctatatctgg

SEQ ID NO: 1764 - DNA, 21 bp, Amaranthus sp.
gagtatgaaagctgcatttgg

SEQ ID NO: 1765 - DNA, 21 bp, Amaranthus sp.
gagggttggaaactattagga

SEQ ID NO: 1766 - DNA, 21 bp, Amaranthus sp.
gagggtcctaatagtttccaa

SEQ ID NO: 1767 - DNA, 21 bp, Amaranthus sp.
gaggattattcttcctttcct

SEQ ID NO: 1768 - DNA, 21 bp, Amaranthus sp.
gagctttcctggtaagattag

SEQ ID NO: 1769 - DNA, 21 bp, Amaranthus sp.
gagctacattggaggtgctac

SEQ ID NO: 1770 - DNA, 21 bp, Amaranthus sp.
gagcgacttatcaatattaga

SEQ ID NO: 1771 - DNA, 21 bp, Amaranthus sp.
gagcaaaagggtggtagtatc

SEQ ID NO: 1772 - DNA, 21 bp, Amaranthus sp.
gagattacggcgcacaaattc

SEQ ID NO: 1773 - DNA, 21 bp, Amaranthus sp.
gagatcaaaaaagggaaggtc

SEQ ID NO: 1774 - DNA, 21 bp, Amaranthus sp.
gagagtatggccaaaggcaat

SEQ ID NO: 1775 - DNA, 21 bp, Amaranthus sp.
gagacccccgccttcctaaac

SEQ ID NO: 1776 - DNA, 21 bp, Amaranthus sp.
gactttactgccaagcctagc

SEQ ID NO: 1777 - DNA, 21 bp, Amaranthus sp.
gacttatcaatattagaaagt

SEQ ID NO: 1778 - DNA, 21 bp, Amaranthus sp.
gactgttggatcctttaggaa

SEQ ID NO: 1779 - DNA, 21 bp, Amaranthus sp.
gacgaagcaggctacttgcaa

SEQ ID NO: 1780 - DNA, 21 bp, Amaranthus sp.
gacctttccaaatgcagcttt

SEQ ID NO: 1781 - DNA, 21 bp, Amaranthus sp.
gaccttgatcttgagctacat

SEQ ID NO: 1782 - DNA, 21 bp, Amaranthus sp.
gaccttcccttttttgatctc

SEQ ID NO: 1783 - DNA, 21 bp, Amaranthus sp.
gaccttagagcaaaagggtgg

SEQ ID NO: 1784 - DNA, 21 bp, Amaranthus sp.
gaccggtttctgttaggacca

SEQ ID NO: 1785 - DNA, 21 bp, Amaranthus sp.
gaccctcttcccagatatagc

SEQ ID NO: 1786 - DNA, 21 bp, Amaranthus sp.
gacccccgccttcctaaacct

SEQ ID NO: 1787 - DNA, 21 bp, Amaranthus sp.
gaccagccctaatcttaccag

SEQ ID NO: 1788 - DNA, 21 bp, Amaranthus sp.
gaccaaagcggttgtcatgac

SEQ ID NO: 1789 - DNA, 21 bp, Amaranthus sp.
gacactttctaatattgataa

SEQ ID NO: 1790 - DNA, 21 bp, Amaranthus sp.
gacaaccgctttggtcctaac

SEQ ID NO: 1791 - DNA, 21 bp, Amaranthus sp.
gaatttgtgcgccgtaatctc

SEQ ID NO: 1792 - DNA, 21 bp, Amaranthus sp.
gaatggtaaattaaggcctgt

SEQ ID NO: 1793 - DNA, 21 bp, Amaranthus sp.
gaaggaacaggccttaattta

SEQ ID NO: 1794 - DNA, 21 bp, Amaranthus sp.
gaagcaggctacttgcaatgt

SEQ ID NO: 1795 - DNA, 21 bp, Amaranthus sp.
gaagagggtcctaatagtttc

SEQ ID NO: 1796 - DNA, 21 bp, Amaranthus sp.
gaagaatttgtgcgccgtaat

SEQ ID NO: 1797 - DNA, 21 bp, Amaranthus sp.
gaacaggccttaatttaccat

SEQ ID NO: 1798 - DNA, 21 bp, Amaranthus sp.
gaaaggtctggaccttagagc

SEQ ID NO: 1799 - DNA, 21 bp, Amaranthus sp.
gaaaggaagaataatcctcca

SEQ ID NO: 1800 - DNA, 21 bp, Amaranthus sp.
gaaagctgcatttggaaaggt

SEQ ID NO: 1801 - DNA, 21 bp, Amaranthus sp.
gaaagctcatgagatcaaaaa

SEQ ID NO: 1802 - DNA, 21 bp, Amaranthus sp.
gaaactattaggaccctcttc

SEQ ID NO: 1803 - DNA, 21 bp, Amaranthus sp.
gaaaccggtccatcgggtgtt

SEQ ID NO: 1804 - DNA, 21 bp, Amaranthus sp.
gaaaaattctgataaatccaa

SEQ ID NO: 1805 - DNA, 21 bp, Amaranthus sp.
cttttttgatctcatgagctt

SEQ ID NO: 1806 - DNA, 21 bp, Amaranthus sp.
cttttgctctaaggtccagac

SEQ ID NO: 1807 - DNA, 21 bp, Amaranthus sp.
ctttggtcctaacagaaaccg

SEQ ID NO: 1808 - DNA, 21 bp, Amaranthus sp.
ctttggccatactctcactcc

SEQ ID NO: 1809 - DNA, 21 bp, Amaranthus sp.
ctttctaatattgataagtcg

SEQ ID NO: 1810 - DNA, 21 bp, Amaranthus sp.
ctttcgcatttggatttatca

SEQ ID NO: 1811 - DNA, 21 bp, Amaranthus sp.
ctttcctggtaagattagggc

SEQ ID NO: 1812 - DNA, 21 bp, Amaranthus sp.
ctttcctaaaggatccaacag

SEQ ID NO: 1813 - DNA, 21 bp, Amaranthus sp.
ctttccaaatgcagctttcat

SEQ ID NO: 1814 - DNA, 21 bp, Amaranthus sp.
ctttcaatccactgtcaaccg

SEQ ID NO: 1815 - DNA, 21 bp, Amaranthus sp.
ctttactgccaagcctagcag

SEQ ID NO: 1816 - DNA, 21 bp, Amaranthus sp.
cttggcagtaaagtcaaacta

SEQ ID NO: 1817 - DNA, 21 bp, Amaranthus sp.
cttgatcttgagctacattgg

SEQ ID NO: 1818 - DNA, 21 bp, Amaranthus sp.
cttgagctacattggaggtgc

SEQ ID NO: 1819 - DNA, 21 bp, Amaranthus sp.
cttcctaaacctaagggccag

SEQ ID NO: 1820 - DNA, 21 bp, Amaranthus sp.
cttcccttttttgatctcatg

SEQ ID NO: 1821 - DNA, 21 bp, Amaranthus sp.
cttcatacattgcaagtagcc

SEQ ID NO: 1822 - DNA, 21 bp, Amaranthus sp.
cttatcaatattagaaagtgt

SEQ ID NO: 1823 - DNA, 21 bp, Amaranthus sp.
cttaggtttaggaaggcgggg

SEQ ID NO: 1824 - DNA, 21 bp, Amaranthus sp.
cttagagcaaaagggtggtag

SEQ ID NO: 1825 - DNA, 21 bp, Amaranthus sp.
cttactatggcggttgacagt

SEQ ID NO: 1826 - DNA, 21 bp, Amaranthus sp.
cttaccaggaaagctcatgag

SEQ ID NO: 1827 - DNA, 21 bp, Amaranthus sp.
ctgttggatcctttaggaaag

SEQ ID NO: 1828 - DNA, 21 bp, Amaranthus sp.
ctgttaggaccaaagcggttg

SEQ ID NO: 1829 - DNA, 21 bp, Amaranthus sp.
ctgtgcttactatggcggttg

SEQ ID NO: 1830 - DNA, 21 bp, Amaranthus sp.
ctgtcaaccgccatagtaagc

SEQ ID NO: 1831 - DNA, 21 bp, Amaranthus sp.
ctggtaagattagggctggtc

SEQ ID NO: 1832 - DNA, 21 bp, Amaranthus sp.
ctgggagtgagagtatggcca

SEQ ID NO: 1833 - DNA, 21 bp, Amaranthus sp.
ctgggaagagggtcctaatag

SEQ ID NO: 1834 - DNA, 21 bp, Amaranthus sp.
ctggcccttaggtttaggaag

SEQ ID NO: 1835 - DNA, 21 bp, Amaranthus sp.
ctggaccttagagcaaaaggg

SEQ ID NO: 1836 - DNA, 21 bp, Amaranthus sp.
ctgctaggcttggcagtaaag

SEQ ID NO: 1837 - DNA, 21 bp, Amaranthus sp.
ctgcctttcgcatttggattt

SEQ ID NO: 1838 - DNA, 21 bp, Amaranthus sp.
ctgccaagcctagcagcaatg

SEQ ID NO: 1839 - DNA, 21 bp, Amaranthus sp.
ctgcatttggaaaggtctgga

SEQ ID NO: 1840 - DNA, 21 bp, Amaranthus sp.
ctgataaatccaaatgcgaaa

SEQ ID NO: 1841 - DNA, 21 bp, Amaranthus sp.
ctctaaggtccagacctttcc

SEQ ID NO: 1842 - DNA, 21 bp, Amaranthus sp.
ctcgagacccccgccttccta

SEQ ID NO: 1843 - DNA, 21 bp, Amaranthus sp.
ctccaatgtagctcaagatca

SEQ ID NO: 1844 - DNA, 21 bp, Amaranthus sp.
ctcattatgttacctaccgcc

SEQ ID NO: 1845 - DNA, 21 bp, Amaranthus sp.
ctcatgagctttcctggtaag

SEQ ID NO: 1846 - DNA, 21 bp, Amaranthus sp.
ctcatgagatcaaaaaaggga

SEQ ID NO: 1847 - DNA, 21 bp, Amaranthus sp.
ctcagaaaaattctgataaat

SEQ ID NO: 1848 - DNA, 21 bp, Amaranthus sp.
ctattcaggaaaggaagaata

SEQ ID NO: 1849 - DNA, 21 bp, Amaranthus sp.
ctattaggaccctcttcccag

SEQ ID NO: 1850 - DNA, 21 bp, Amaranthus sp.
ctatggcggttgacagtggat

SEQ ID NO: 1851 - DNA, 21 bp, Amaranthus sp.
ctatatctgggaagagggtcc

SEQ ID NO: 1852 - DNA, 21 bp, Amaranthus sp.
ctaggcttggcagtaaagtca

SEQ ID NO: 1853 - DNA, 21 bp, Amaranthus sp.
ctagcagcaatggcggtaggt

SEQ ID NO: 1854 - DNA, 21 bp, Amaranthus sp.
ctacggaccttcccttttttg

SEQ ID NO: 1855 - DNA, 21 bp, Amaranthus sp.
ctaccgccattgctgctaggc

SEQ ID NO: 1856 - DNA, 21 bp, Amaranthus sp.
ctaccatggagtccgatggct

SEQ ID NO: 1857 - DNA, 21 bp, Amaranthus sp.
ctaccacccttttgctctaag

SEQ ID NO: 1858 - DNA, 21 bp, Amaranthus sp.
ctaatcttaccaggaaagctc

SEQ ID NO: 1859 - DNA, 21 bp, Amaranthus sp.
ctaatattgataagtcgctca

SEQ ID NO: 1860 - DNA, 21 bp, Amaranthus sp.
ctaaggtccagacctttccaa

SEQ ID NO: 1861 - DNA, 21 bp, Amaranthus sp.
ctaagggccagactgttggat

SEQ ID NO: 1862 - DNA, 21 bp, Amaranthus sp.
ctaacagaaaccggtccatcg

SEQ ID NO: 1863 - DNA, 21 bp, Amaranthus sp.
ctaaaggatccaacagtctgg

SEQ ID NO: 1864 - DNA, 21 bp, Amaranthus sp.
ctaaacctaagggccagactg

SEQ ID NO: 1865 - DNA, 21 bp, Amaranthus sp.
cggtttctgttaggaccaaag

SEQ ID NO: 1866 - DNA, 21 bp, Amaranthus sp.
cggttgacagtggattgaaag

SEQ ID NO: 1867 - DNA, 21 bp, Amaranthus sp.
cggtccatcgggtgtttgata

SEQ ID NO: 1868 - DNA, 21 bp, Amaranthus sp.
cggctgcctttcgcatttgga

SEQ ID NO: 1869 - DNA, 21 bp, Amaranthus sp.
cggcgatgatactaccaccct

SEQ ID NO: 1870 - DNA, 21 bp, Amaranthus sp.
cggaccttcccttttttgatc

SEQ ID NO: 1871 - DNA, 21 bp, Amaranthus sp.
cgctttggtcctaacagaaac

SEQ ID NO: 1872 - DNA, 21 bp, Amaranthus sp.
cgccttcctaaacctaagggc

SEQ ID NO: 1873 - DNA, 21 bp, Amaranthus sp.
cgccattgctgctaggcttgg

SEQ ID NO: 1874 - DNA, 21 bp, Amaranthus sp.
cgccatagtaagcacaggatc

SEQ ID NO: 1875 - DNA, 21 bp, Amaranthus sp.
cgcatttggatttatcagaat

SEQ ID NO: 1876 - DNA, 21 bp, Amaranthus sp.
cgcaagttcatcttcactctt

SEQ ID NO: 1877 - DNA, 21 bp, Amaranthus sp.
cgatggaccggtttctgttag

SEQ ID NO: 1878 - DNA, 21 bp, Amaranthus sp.
cgatgatactaccaccctttt

SEQ ID NO: 1879 - DNA, 21 bp, Amaranthus sp.
cgagattacggcgcacaaatt

SEQ ID NO: 1880 - DNA, 21 bp, Amaranthus sp.
cgagacccccgccttcctaaa

SEQ ID NO: 1881 - DNA, 21 bp, Amaranthus sp.
cgacttatcaatattagaaag

SEQ ID NO: 1882 - DNA, 21 bp, Amaranthus sp.
cgaagcaggctacttgcaatg

SEQ ID NO: 1883 - DNA, 21 bp, Amaranthus sp.
ccttttttgatctcatgagct

SEQ ID NO: 1884 - DNA, 21 bp, Amaranthus sp.
ccttttgctctaaggtccaga

SEQ ID NO: 1885 - DNA, 21 bp, Amaranthus sp.
cctttggccatactctcactc

SEQ ID NO: 1886 - DNA, 21 bp, Amaranthus sp.
cctttcgcatttggatttatc

SEQ ID NO: 1887 - DNA, 21 bp, Amaranthus sp.
cctttcctaaaggatccaaca

SEQ ID NO: 1888 - DNA, 21 bp, Amaranthus sp.
cctttccaaatgcagctttca

SEQ ID NO: 1889 - DNA, 21 bp, Amaranthus sp.
ccttgatcttgagctacattg

SEQ ID NO: 1890 - DNA, 21 bp, Amaranthus sp.
ccttcctaaacctaagggcca

SEQ ID NO: 1891 - DNA, 21 bp, Amaranthus sp.
ccttcccttttttgatctcat

SEQ ID NO: 1892 - DNA, 21 bp, Amaranthus sp.
ccttcatacattgcaagtagc

SEQ ID NO: 1893 - DNA, 21 bp, Amaranthus sp.
ccttaggtttaggaaggcggg

SEQ ID NO: 1894 - DNA, 21 bp, Amaranthus sp.
ccttagagcaaaagggtggta

SEQ ID NO: 1895 - DNA, 21 bp, Amaranthus sp.
cctgtgcttactatggcggtt

SEQ ID NO: 1896 - DNA, 21 bp, Amaranthus sp.
cctggtaagattagggctggt

SEQ ID NO: 1897 - DNA, 21 bp, Amaranthus sp.
cctcgagacccccgccttcct

SEQ ID NO: 1898 - DNA, 21 bp, Amaranthus sp.
cctccaatgtagctcaagatc

SEQ ID NO: 1899 - DNA, 21 bp, Amaranthus sp.
cctagcagcaatggcggtagg

SEQ ID NO: 1900 - DNA, 21 bp, Amaranthus sp.
cctacggaccttccctttttt

SEQ ID NO: 1901 - DNA, 21 bp, Amaranthus sp.
cctaccgccattgctgctagg

SEQ ID NO: 1902 - DNA, 21 bp, Amaranthus sp.
cctaatcttaccaggaaagct

SEQ ID NO: 1903 - DNA, 21 bp, Amaranthus sp.
cctaagggccagactgttgga

SEQ ID NO: 1904 - DNA, 21 bp, Amaranthus sp.
cctaacagaaaccggtccatc

SEQ ID NO: 1905 - DNA, 21 bp, Amaranthus sp.
cctaaaggatccaacagtctg

SEQ ID NO: 1906 - DNA, 21 bp, Amaranthus sp.
cctaaacctaagggccagact

SEQ ID NO: 1907 - DNA, 21 bp, Amaranthus sp.
ccggtttctgttaggaccaaa

SEQ ID NO: 1908 - DNA, 21 bp, Amaranthus sp.
ccggtccatcgggtgtttgat

SEQ ID NO: 1909 - DNA, 21 bp, Amaranthus sp.
ccggcgatgatactaccaccc

SEQ ID NO: 1910 - DNA, 21 bp, Amaranthus sp.
ccgctttggtcctaacagaaa

SEQ ID NO: 1911 - DNA, 21 bp, Amaranthus sp.
ccgccttcctaaacctaaggg

SEQ ID NO: 1912 - DNA, 21 bp, Amaranthus sp.
ccgccattgctgctaggcttg

SEQ ID NO: 1913 - DNA, 21 bp, Amaranthus sp.
ccgccatagtaagcacaggat

SEQ ID NO: 1914 - DNA, 21 bp, Amaranthus sp.
ccgcaagttcatcttcactct

SEQ ID NO: 1915 - DNA, 21 bp, Amaranthus sp.
ccgatggaccggtttctgtta

SEQ ID NO: 1916 - DNA, 21 bp, Amaranthus sp.
ccgagattacggcgcacaaat

SEQ ID NO: 1917 - DNA, 21 bp, Amaranthus sp.
cccttttttgatctcatgagc

SEQ ID NO: 1918 - DNA, 21 bp, Amaranthus sp.
cccttttgctctaaggtccag

SEQ ID NO: 1919 - DNA, 21 bp, Amaranthus sp.
cccttaggtttaggaaggcgg

SEQ ID NO: 1920 - DNA, 21 bp, Amaranthus sp.
ccctaatcttaccaggaaagc

SEQ ID NO: 1921 - DNA, 21 bp, Amaranthus sp.
cccgccttcctaaacctaagg

SEQ ID NO: 1922 - DNA, 21 bp, Amaranthus sp.
cccgatggaccggtttctgtt

SEQ ID NO: 1923 - DNA, 21 bp, Amaranthus sp.
ccccgccttcctaaacctaag

SEQ ID NO: 1924 - DNA, 21 bp, Amaranthus sp.
cccccgccttcctaaacctaa

SEQ ID NO: 1925 - DNA, 21 bp, Amaranthus sp.
cccagatatagccatcggact

SEQ ID NO: 1926 - DNA, 21 bp, Amaranthus sp.
ccattgctgctaggcttggca

SEQ ID NO: 1927 - DNA, 21 bp, Amaranthus sp.
ccattgagcgacttatcaata

SEQ ID NO: 1928 - DNA, 21 bp, Amaranthus sp.
ccatggagtccgatggctata

SEQ ID NO: 1929 - DNA, 21 bp, Amaranthus sp.
ccatactctcactcccagaac

SEQ ID NO: 1930 - DNA, 21 bp, Amaranthus sp.
ccagtcgcagcagtgtccctt

SEQ ID NO: 1931 - DNA, 21 bp, Amaranthus sp.
ccaggaaagctcatgagatca

SEQ ID NO: 1932 - DNA, 21 bp, Amaranthus sp.
ccagccctaatcttaccagga

SEQ ID NO: 1933 - DNA, 21 bp, Amaranthus sp.
ccagatatagccatcggactc

SEQ ID NO: 1934 - DNA, 21 bp, Amaranthus sp.
ccagactgttggatcctttag

SEQ ID NO: 1935 - DNA, 21 bp, Amaranthus sp.
ccagacctttccaaatgcagc

SEQ ID NO: 1936 - DNA, 21 bp, Amaranthus sp.
ccactgtcaaccgccatagta

SEQ ID NO: 1937 - DNA, 21 bp, Amaranthus sp.
ccacccttttgctctaaggtc

SEQ ID NO: 1938 - DNA, 21 bp, Amaranthus sp.
ccaatgtagctcaagatcaag

SEQ ID NO: 1939 - DNA, 21 bp, Amaranthus sp.
ccaagcctagcagcaatggcg

SEQ ID NO: 1940 - DNA, 21 bp, Amaranthus sp.
ccaagaccagccctaatctta

SEQ ID NO: 1941 - DNA, 21 bp, Amaranthus sp.
ccaacagtctggcccttaggt

SEQ ID NO: 1942 - DNA, 21 bp, Amaranthus sp.
ccaaatgcagctttcatactc

SEQ ID NO: 1943 - DNA, 21 bp, Amaranthus sp.
ccaaagcggttgtcatgactg

SEQ ID NO: 1944 - DNA, 21 bp, Amaranthus sp.
catttggatttatcagaattt

SEQ ID NO: 1945 - DNA, 21 bp, Amaranthus sp.
catttggaaaggtctggacct

SEQ ID NO: 1946 - DNA, 21 bp, Amaranthus sp.
cattgctgctaggcttggcag

SEQ ID NO: 1947 - DNA, 21 bp, Amaranthus sp.
cattgcaagtagcctgcttcg

SEQ ID NO: 1948 - DNA, 21 bp, Amaranthus sp.
cattgagcgacttatcaatat

SEQ ID NO: 1949 - DNA, 21 bp, Amaranthus sp.
cattatgttacctaccgccat

SEQ ID NO: 1950 - DNA, 21 bp, Amaranthus sp.
catggagtccgatggctatat

SEQ ID NO: 1951 - DNA, 21 bp, Amaranthus sp.
catgagctttcctggtaagat

SEQ ID NO: 1952 - DNA, 21 bp, Amaranthus sp.
catgagatcaaaaaagggaag

SEQ ID NO: 1953 - DNA, 21 bp, Amaranthus sp.
catgacaaccgctttggtcct

SEQ ID NO: 1954 - DNA, 21 bp, Amaranthus sp.
catcttcactcttttgtaata

SEQ ID NO: 1955 - DNA, 21 bp, Amaranthus sp.
catacattgcaagtagcctgc

SEQ ID NO: 1956 - DNA, 21 bp, Amaranthus sp.
cagtctggcccttaggtttag

SEQ ID NO: 1957 - DNA, 21 bp, Amaranthus sp.
cagtcatgacaaccgctttgg

SEQ ID NO: 1958 - DNA, 21 bp, Amaranthus sp.
caggctacttgcaatgtatga

SEQ ID NO: 1959 - DNA, 21 bp, Amaranthus sp.
caggccttaatttaccattcc

SEQ ID NO: 1960 - DNA, 21 bp, Amaranthus sp.
caggaaaggaagaataatcct

SEQ ID NO: 1961 - DNA, 21 bp, Amaranthus sp.
caggaaagctcatgagatcaa

SEQ ID NO: 1962 - DNA, 21 bp, Amaranthus sp.
cagctttcatactcaactttg

SEQ ID NO: 1963 - DNA, 21 bp, Amaranthus sp.
cagccctaatcttaccaggaa

SEQ ID NO: 1964 - DNA, 21 bp, Amaranthus sp.
cagcaatggcggtaggtaaca

SEQ ID NO: 1965 - DNA, 21 bp, Amaranthus sp.
cagatatagccatcggactcc

SEQ ID NO: 1966 - DNA, 21 bp, Amaranthus sp.
cagactgttggatcctttagg

SEQ ID NO: 1967 - DNA, 21 bp, Amaranthus sp.
cagacctttccaaatgcagct

SEQ ID NO: 1968 - DNA, 21 bp, Amaranthus sp.
cagaatttttctgagatcctt

SEQ ID NO: 1969 - DNA, 21 bp, Amaranthus sp.
cagaaaccggtccatcgggtg

SEQ ID NO: 1970 - DNA, 21 bp, Amaranthus sp.
cagaaaaattctgataaatcc

SEQ ID NO: 1971 - DNA, 21 bp, Amaranthus sp.
cactttctaatattgataagt

SEQ ID NO: 1972 - DNA, 21 bp, Amaranthus sp.
cactgtcaaccgccatagtaa

SEQ ID NO: 1973 - DNA, 21 bp, Amaranthus sp.
cacctccaatgtagctcaaga

SEQ ID NO: 1974 - DNA, 21 bp, Amaranthus sp.
cacccttttgctctaaggtcc

SEQ ID NO: 1975 - DNA, 21 bp, Amaranthus sp.
cacccgatggaccggtttctg

SEQ ID NO: 1976 - DNA, 21 bp, Amaranthus sp.
caccattgagcgacttatcaa

SEQ ID NO: 1977 - DNA, 21 bp, Amaranthus sp.
caccaagaccagccctaatct

SEQ ID NO: 1978 - DNA, 21 bp, Amaranthus sp.
caatgtagctcaagatcaagg

SEQ ID NO: 1979 - DNA, 21 bp, Amaranthus sp.
caatggcggtaggtaacataa

SEQ ID NO: 1980 - DNA, 21 bp, Amaranthus sp.
caatccactgtcaaccgccat

SEQ ID NO: 1981 - DNA, 21 bp, Amaranthus sp.
caagttcatcttcactctttt

SEQ ID NO: 1982 - DNA, 21 bp, Amaranthus sp.
caagcctagcagcaatggcgg

SEQ ID NO: 1983 - DNA, 21 bp, Amaranthus sp.
caagaccagccctaatcttac

SEQ ID NO: 1984 - DNA, 21 bp, Amaranthus sp.
caaccgctttggtcctaacag

SEQ ID NO: 1985 - DNA, 21 bp, Amaranthus sp.
caaccgccatagtaagcacag

SEQ ID NO: 1986 - DNA, 21 bp, Amaranthus sp.
caacagtctggcccttaggtt

SEQ ID NO: 1987 - DNA, 21 bp, Amaranthus sp.
caaatgcagctttcatactca

SEQ ID NO: 1988 - DNA, 21 bp, Amaranthus sp.
caaagttgagtatgaaagctg

SEQ ID NO: 1989 - DNA, 21 bp, Amaranthus sp.
caaagcggttgtcatgactgt

SEQ ID NO: 1990 - DNA, 21 bp, Amaranthus sp.
caaacacccgatggaccggtt

SEQ ID NO: 1991 - DNA, 21 bp, Amaranthus sp.
caaaagggtggtagtatcatc

SEQ ID NO: 1992 - DNA, 21 bp, Amaranthus sp.
caaaagagtgaagatgaactt

SEQ ID NO: 1993 - DNA, 21 bp, Amaranthus sp.
caaaaaagggaaggtccgtag

SEQ ID NO: 1994 - DNA, 21 bp, Amaranthus sp.
atttgtgcgccgtaatctcgg

SEQ ID NO: 1995 - DNA, 21 bp, Amaranthus sp.
atttggatttatcagaatttt

SEQ ID NO: 1996 - DNA, 21 bp, Amaranthus sp.
atttggaaaggtctggacctt

SEQ ID NO: 1997 - DNA, 21 bp, Amaranthus sp.
atttatcagaatttttctgag

SEQ ID NO: 1998 - DNA, 21 bp, Amaranthus sp.
attgctgctaggcttggcagt

SEQ ID NO: 1999 - DNA, 21 bp, Amaranthus sp.
attgcctttggccatactctc

SEQ ID NO: 2000 - DNA, 21 bp, Amaranthus sp.
attgcaagtagcctgcttcgt

SEQ ID NO: 2001 - DNA, 21 bp, Amaranthus sp.
attgataagtcgctcaatggt

SEQ ID NO: 2002 - DNA, 21 bp, Amaranthus sp.
attgagcgacttatcaatatt

SEQ ID NO: 2003 - DNA, 21 bp, Amaranthus sp.
attctgataaatccaaatgcg

SEQ ID NO: 2004 - DNA, 21 bp, Amaranthus sp.
attcaggaaaggaagaataat

SEQ ID NO: 2005 - DNA, 21 bp, Amaranthus sp.
attcaccattgagcgacttat

SEQ ID NO: 2006 - DNA, 21 bp, Amaranthus sp.
attattcttcctttcctgaat

SEQ ID NO: 2007 - DNA, 21 bp, Amaranthus sp.
attatgttacctaccgccatt

SEQ ID NO: 2008 - DNA, 21 bp, Amaranthus sp.
attaggaccctcttcccagat

SEQ ID NO: 2009 - DNA, 21 bp, Amaranthus sp.
attacggcgcacaaattcttc

SEQ ID NO: 2010 - DNA, 21 bp, Amaranthus sp.
attacaaaagagtgaagatga

SEQ ID NO: 2011 - DNA, 21 bp, Amaranthus sp.
atgttacctaccgccattgct

SEQ ID NO: 2012 - DNA, 21 bp, Amaranthus sp.
atgtagctcaagatcaaggtc

SEQ ID NO: 2013 - DNA, 21 bp, Amaranthus sp.
atggtaaattaaggcctgttc

SEQ ID NO: 2014 - DNA, 21 bp, Amaranthus sp.
atggcggttgacagtggattg

SEQ ID NO: 2015 - DNA, 21 bp, Amaranthus sp.
atggcggtaggtaacataatg

SEQ ID NO: 2016 - DNA, 21 bp, Amaranthus sp.
atggagtccgatggctatatc

SEQ ID NO: 2017 - DNA, 21 bp, Amaranthus sp.
atggaccggtttctgttagga

SEQ ID NO: 2018 - DNA, 21 bp, Amaranthus sp.
atgcagctttcatactcaact

SEQ ID NO: 2019 - DNA, 21 bp, Amaranthus sp.
atgatactaccacccttttgc

SEQ ID NO: 2020 - DNA, 21 bp, Amaranthus sp.
atgagctttcctggtaagatt

SEQ ID NO: 2021 - DNA, 21 bp, Amaranthus sp.
atgagatcaaaaaagggaagg

SEQ ID NO: 2022 - DNA, 21 bp, Amaranthus sp.
atgacaaccgctttggtccta

SEQ ID NO: 2023 - DNA, 21 bp, Amaranthus sp.
atgaaagctgcatttggaaag

SEQ ID NO: 2024 - DNA, 21 bp, Amaranthus sp.
atcttgagctacattggaggt

SEQ ID NO: 2025 - DNA, 21 bp, Amaranthus sp.
atcttcactcttttgtaatat

SEQ ID NO: 2026 - DNA, 21 bp, Amaranthus sp.
atcttaccaggaaagctcatg

SEQ ID NO: 2027 - DNA, 21 bp, Amaranthus sp.
atctgggaagagggtcctaat

SEQ ID NO: 2028 - DNA, 21 bp, Amaranthus sp.
atctcatgagctttcctggta

SEQ ID NO: 2029 - DNA, 21 bp, Amaranthus sp.
atctcagaaaaattctgataa

SEQ ID NO: 2030 - DNA, 21 bp, Amaranthus sp.
atcctgtgcttactatggcgg

SEQ ID NO: 2031 - DNA, 21 bp, Amaranthus sp.
atccactgtcaaccgccatag

SEQ ID NO: 2032 - DNA, 21 bp, Amaranthus sp.
atccaacagtctggcccttag

SEQ ID NO: 2033 - DNA, 21 bp, Amaranthus sp.
atccaaatgcgaaaggcagcc

SEQ ID NO: 2034 - DNA, 21 bp, Amaranthus sp.
atcatcgccggtacactcaaa

SEQ ID NO: 2035 - DNA, 21 bp, Amaranthus sp.
atcagaatttttctgagatcc

SEQ ID NO: 2036 - DNA, 21 bp, Amaranthus sp.
atcaatattagaaagtgtcca

SEQ ID NO: 2037 - DNA, 21 bp, Amaranthus sp.
atcaaacacccgatggaccgg

SEQ ID NO: 2038 - DNA, 21 bp, Amaranthus sp.
atcaaaaaagggaaggtccgt

SEQ ID NO: 2039 - DNA, 21 bp, Amaranthus sp.
atattgataagtcgctcaatg

SEQ ID NO: 2040 - DNA, 21 bp, Amaranthus sp.
atattacaaaagagtgaagat

SEQ ID NO: 2041 - DNA, 21 bp, Amaranthus sp.
atatctgggaagagggtccta

SEQ ID NO: 2042 - DNA, 21 bp, Amaranthus sp.
atatagccatcggactccatg

SEQ ID NO: 2043 - DNA, 21 bp, Amaranthus sp.
atagtttgactttactgccaa

SEQ ID NO: 2044 - DNA, 21 bp, Amaranthus sp.
atagccatcggactccatggt

SEQ ID NO: 2045 - DNA, 21 bp, Amaranthus sp.
atactaccacccttttgctct

SEQ ID NO: 2046 - DNA, 21 bp, Amaranthus sp.
atacattgcaagtagcctgct

SEQ ID NO: 2047 - DNA, 21 bp, Amaranthus sp.
ataagtcgctcaatggtgaat

SEQ ID NO: 2048 - DNA, 21 bp, Amaranthus sp.
ataaatccaaatgcgaaaggc

SEQ ID NO: 2049 - DNA, 21 bp, Amaranthus sp.
agtttgactttactgccaagc

SEQ ID NO: 2050 - DNA, 21 bp, Amaranthus sp.
agttgagtatgaaagctgcat

SEQ ID NO: 2051 - DNA, 21 bp, Amaranthus sp.
agttcatcttcactcttttgt

SEQ ID NO: 2052 - DNA, 21 bp, Amaranthus sp.
agtgtaccggcgatgatacta

SEQ ID NO: 2053 - DNA, 21 bp, Amaranthus sp.
agtgagagtatggccaaaggc

SEQ ID NO: 2054 - DNA, 21 bp, Amaranthus sp.
agtctggcccttaggtttagg

SEQ ID NO: 2055 - DNA, 21 bp, Amaranthus sp.
agtcgctcaatggtgaataca

SEQ ID NO: 2056 - DNA, 21 bp, Amaranthus sp.
agtccgatggctatatctggg

SEQ ID NO: 2057 - DNA, 21 bp, Amaranthus sp.
agtcatgacaaccgctttggt

SEQ ID NO: 2058 - DNA, 21 bp, Amaranthus sp.
agtatgaaagctgcatttgga

SEQ ID NO: 2059 - DNA, 21 bp, Amaranthus sp.
agtatcatcgccggtacactc

SEQ ID NO: 2060 - DNA, 21 bp, Amaranthus sp.
aggtttaggaaggcgggggtc

SEQ ID NO: 2061 - DNA, 21 bp, Amaranthus sp.
aggtctggaccttagagcaaa

SEQ ID NO: 2062 - DNA, 21 bp, Amaranthus sp.
aggtccagacctttccaaatg

SEQ ID NO: 2063 - DNA, 21 bp, Amaranthus sp.
agggttggaaactattaggac

SEQ ID NO: 2064 - DNA, 21 bp, Amaranthus sp.
agggtggtagtatcatcgccg

SEQ ID NO: 2065 - DNA, 21 bp, Amaranthus sp.
agggtcctaatagtttccaac

SEQ ID NO: 2066 - DNA, 21 bp, Amaranthus sp.
agggccagactgttggatcct

SEQ ID NO: 2067 - DNA, 21 bp, Amaranthus sp.
aggcttggcagtaaagtcaaa

SEQ ID NO: 2068 - DNA, 21 bp, Amaranthus sp.
aggctacttgcaatgtatgaa

SEQ ID NO: 2069 - DNA, 21 bp, Amaranthus sp.
aggccttaatttaccattcca

SEQ ID NO: 2070 - DNA, 21 bp, Amaranthus sp.
aggattattcttcctttcctg

SEQ ID NO: 2071 - DNA, 21 bp, Amaranthus sp.
aggatctcagaaaaattctga

SEQ ID NO: 2072 - DNA, 21 bp, Amaranthus sp.
aggatccaacagtctggccct

SEQ ID NO: 2073 - DNA, 21 bp, Amaranthus sp.
aggaccttgatcttgagctac

SEQ ID NO: 2074 - DNA, 21 bp, Amaranthus sp.
aggaccctcttcccagatata

SEQ ID NO: 2075 - DNA, 21 bp, Amaranthus sp.
aggaccaaagcggttgtcatg

SEQ ID NO: 2076 - DNA, 21 bp, Amaranthus sp.
aggaaggcgggggtctcgagg

SEQ ID NO: 2077 - DNA, 21 bp, Amaranthus sp.
aggaacaggccttaatttacc

SEQ ID NO: 2078 - DNA, 21 bp, Amaranthus sp.
aggaaaggaagaataatcctc

SEQ ID NO: 2079 - DNA, 21 bp, Amaranthus sp.
aggaaagctcatgagatcaaa

SEQ ID NO: 2080 - DNA, 21 bp, Amaranthus sp.
agctttcctggtaagattagg

SEQ ID NO: 2081 - DNA, 21 bp, Amaranthus sp.
agctgcatttggaaaggtctg

SEQ ID NO: 2082 - DNA, 21 bp, Amaranthus sp.
agctcatgagatcaaaaaagg

SEQ ID NO: 2083 - DNA, 21 bp, Amaranthus sp.
agctacattggaggtgctaca

SEQ ID NO: 2084 - DNA, 21 bp, Amaranthus sp.
agcgacttatcaatattagaa

SEQ ID NO: 2085 - DNA, 21 bp, Amaranthus sp.
agcctagcagcaatggcggta

SEQ ID NO: 2086 - DNA, 21 bp, Amaranthus sp.
agccctaatcttaccaggaaa

SEQ ID NO: 2087 - DNA, 21 bp, Amaranthus sp.
agccatcggactccatggtag

SEQ ID NO: 2088 - DNA, 21 bp, Amaranthus sp.
agcaggctacttgcaatgtat

SEQ ID NO: 2089 - DNA, 21 bp, Amaranthus sp.
agcagcaatggcggtaggtaa

SEQ ID NO: 2090 - DNA, 21 bp, Amaranthus sp.
agcacctccaatgtagctcaa

SEQ ID NO: 2091 - DNA, 21 bp, Amaranthus sp.
agcaatggcggtaggtaacat

SEQ ID NO: 2092 - DNA, 21 bp, Amaranthus sp.
agcaaaagggtggtagtatca

SEQ ID NO: 2093 - DNA, 21 bp, Amaranthus sp.
agattagggctggtcttggtg

SEQ ID NO: 2094 - DNA, 21 bp, Amaranthus sp.
agattacggcgcacaaattct

SEQ ID NO: 2095 - DNA, 21 bp, Amaranthus sp.
agatcaaaaaagggaaggtcc

SEQ ID NO: 2096 - DNA, 21 bp, Amaranthus sp.
agatatagccatcggactcca

SEQ ID NO: 2097 - DNA, 21 bp, Amaranthus sp.
agagtgaagatgaacttgcgg

SEQ ID NO: 2098 - DNA, 21 bp, Amaranthus sp.
agagggtcctaatagtttcca

SEQ ID NO: 2099 - DNA, 21 bp, Amaranthus sp.
agagcaaaagggtggtagtat

SEQ ID NO: 2100 - DNA, 21 bp, Amaranthus sp.
agactgttggatcctttagga

SEQ ID NO: 2101 - DNA, 21 bp, Amaranthus sp.
agacctttccaaatgcagctt

SEQ ID NO: 2102 - DNA, 21 bp, Amaranthus sp.
agacccccgccttcctaaacc

SEQ ID NO: 2103 - DNA, 21 bp, Amaranthus sp.
agaccagccctaatcttacca

SEQ ID NO: 2104 - DNA, 21 bp, Amaranthus sp.
agaatttgtgcgccgtaatct

SEQ ID NO: 2105 - DNA, 21 bp, Amaranthus sp.
agaaaccggtccatcgggtgt

SEQ ID NO: 2106 - DNA, 21 bp, Amaranthus sp.
agaaaaattctgataaatcca

SEQ ID NO: 2107 - DNA, 21 bp, Amaranthus sp.
actttctaatattgataagtc

SEQ ID NO: 2108 - DNA, 21 bp, Amaranthus sp.
actttactgccaagcctagca

SEQ ID NO: 2109 - DNA, 21 bp, Amaranthus sp.
acttatcaatattagaaagtg

SEQ ID NO: 2110 - DNA, 21 bp, Amaranthus sp.
actgttggatcctttaggaaa

SEQ ID NO: 2111 - DNA, 21 bp, Amaranthus sp.
actgtcaaccgccatagtaag

SEQ ID NO: 2112 - DNA, 21 bp, Amaranthus sp.
actgccaagcctagcagcaat

SEQ ID NO: 2113 - DNA, 21 bp, Amaranthus sp.
actattaggaccctcttccca

SEQ ID NO: 2114 - DNA, 21 bp, Amaranthus sp.
actatggcggttgacagtgga

SEQ ID NO: 2115 - DNA, 21 bp, Amaranthus sp.
actaccatggagtccgatggc

SEQ ID NO: 2116 - DNA, 21 bp, Amaranthus sp.
actaccacccttttgctctaa

SEQ ID NO: 2117 - DNA, 21 bp, Amaranthus sp.
acggcgcacaaattcttcaac

SEQ ID NO: 2118 - DNA, 21 bp, Amaranthus sp.
acggaccttcccttttttgat

SEQ ID NO: 2119 - DNA, 21 bp, Amaranthus sp.
acgaagcaggctacttgcaat

SEQ ID NO: 2120 - DNA, 21 bp, Amaranthus sp.
acctttccaaatgcagctttc

SEQ ID NO: 2121 - DNA, 21 bp, Amaranthus sp.
accttgatcttgagctacatt

SEQ ID NO: 2122 - DNA, 21 bp, Amaranthus sp.
accttcccttttttgatctca

SEQ ID NO: 2123 - DNA, 21 bp, Amaranthus sp.
accttagagcaaaagggtggt

SEQ ID NO: 2124 - DNA, 21 bp, Amaranthus sp.
acctccaatgtagctcaagat

SEQ ID NO: 2125 - DNA, 21 bp, Amaranthus sp.
acctaccgccattgctgctag

SEQ ID NO: 2126 - DNA, 21 bp, Amaranthus sp.
acctaagggccagactgttgg

SEQ ID NO: 2127 - DNA, 21 bp, Amaranthus sp.
accggtttctgttaggaccaa

SEQ ID NO: 2128 - DNA, 21 bp, Amaranthus sp.
accggtccatcgggtgtttga

SEQ ID NO: 2129 - DNA, 21 bp, Amaranthus sp.
accggcgatgatactaccacc

SEQ ID NO: 2130 - DNA, 21 bp, Amaranthus sp.
accgctttggtcctaacagaa

SEQ ID NO: 2131 - DNA, 21 bp, Amaranthus sp.
accgccattgctgctaggctt

SEQ ID NO: 2132 - DNA, 21 bp, Amaranthus sp.
accgccatagtaagcacagga

SEQ ID NO: 2133 - DNA, 21 bp, Amaranthus sp.
acccttttgctctaaggtcca

SEQ ID NO: 2134 - DNA, 21 bp, Amaranthus sp.
accctcttcccagatatagcc

SEQ ID NO: 2135 - DNA, 21 bp, Amaranthus sp.
acccgatggaccggtttctgt

SEQ ID NO: 2136 - DNA, 21 bp, Amaranthus sp.
acccccgccttcctaaaccta

SEQ ID NO: 2137 - DNA, 21 bp, Amaranthus sp.
accattgagcgacttatcaat

SEQ ID NO: 2138 - DNA, 21 bp, Amaranthus sp.
accatggagtccgatggctat

SEQ ID NO: 2139 - DNA, 21 bp, Amaranthus sp.
accaggaaagctcatgagatc

SEQ ID NO: 2140 - DNA, 21 bp, Amaranthus sp.
accagccctaatcttaccagg

SEQ ID NO: 2141 - DNA, 21 bp, Amaranthus sp.
accacccttttgctctaaggt

SEQ ID NO: 2142 - DNA, 21 bp, Amaranthus sp.
accaagaccagccctaatctt

SEQ ID NO: 2143 - DNA, 21 bp, Amaranthus sp.
accaaagcggttgtcatgact

SEQ ID NO: 2144 - DNA, 21 bp, Amaranthus sp.
acattgcaagtagcctgcttc

SEQ ID NO: 2145 - DNA, 21 bp, Amaranthus sp.
acagtctggcccttaggttta

SEQ ID NO: 2146 - DNA, 21 bp, Amaranthus sp.
acagtcatgacaaccgctttg

SEQ ID NO: 2147 - DNA, 21 bp, Amaranthus sp.
acaggccttaatttaccattc

SEQ ID NO: 2148 - DNA, 21 bp, Amaranthus sp.
acagaaaccggtccatcgggt

SEQ ID NO: 2149 - DNA, 21 bp, Amaranthus sp.
acactttctaatattgataag

SEQ ID NO: 2150 - DNA, 21 bp, Amaranthus sp.
acacccgatggaccggtttct

SEQ ID NO: 2151 - DNA, 21 bp, Amaranthus sp.
acaaccgctttggtcctaaca

SEQ ID NO: 2152 - DNA, 21 bp, Amaranthus sp.
acaaaagagtgaagatgaact

SEQ ID NO: 2153 - DNA, 21 bp, Amaranthus sp.
aatttgtgcgccgtaatctcg

SEQ ID NO: 2154 - DNA, 21 bp, Amaranthus sp.
aattctgataaatccaaatgc

SEQ ID NO: 2155 - DNA, 21 bp, Amaranthus sp.
aatgtagctcaagatcaaggt

SEQ ID NO: 2156 - DNA, 21 bp, Amaranthus sp.
aatggtaaattaaggcctgtt

SEQ ID NO: 2157 - DNA, 21 bp, Amaranthus sp.
aatggcggtaggtaacataat

SEQ ID NO: 2158 - DNA, 21 bp, Amaranthus sp.
aatgcagctttcatactcaac

SEQ ID NO: 2159 - DNA, 21 bp, Amaranthus sp.
aatcttaccaggaaagctcat

SEQ ID NO: 2160 - DNA, 21 bp, Amaranthus sp.
aatccactgtcaaccgccata

SEQ ID NO: 2161 - DNA, 21 bp, Amaranthus sp.
aatccaaatgcgaaaggcagc

SEQ ID NO: 2162 - DNA, 21 bp, Amaranthus sp.
aatattgataagtcgctcaat

SEQ ID NO: 2163 - DNA, 21 bp, Amaranthus sp.
aagttgagtatgaaagctgca

SEQ ID NO: 2164 - DNA, 21 bp, Amaranthus sp.
aagttcatcttcactcttttg

SEQ ID NO: 2165 - DNA, 21 bp, Amaranthus sp.
aagtcgctcaatggtgaatac

SEQ ID NO: 2166 - DNA, 21 bp, Amaranthus sp.
aaggtctggaccttagagcaa

SEQ ID NO: 2167 - DNA, 21 bp, Amaranthus sp.
aaggtccagacctttccaaat

SEQ ID NO: 2168 - DNA, 21 bp, Amaranthus sp.
aagggtggtagtatcatcgcc

SEQ ID NO: 2169 - DNA, 21 bp, Amaranthus sp.
aagggccagactgttggatcc

SEQ ID NO: 2170 - DNA, 21 bp, Amaranthus sp.
aagggacactgctgcgactgg

SEQ ID NO: 2171 - DNA, 21 bp, Amaranthus sp.
aaggatctcagaaaaattctg

SEQ ID NO: 2172 - DNA, 21 bp, Amaranthus sp.
aaggatccaacagtctggccc

SEQ ID NO: 2173 - DNA, 21 bp, Amaranthus sp.
aaggaagaataatcctccacc

SEQ ID NO: 2174 - DNA, 21 bp, Amaranthus sp.
aaggaacaggccttaatttac

SEQ ID NO: 2175 - DNA, 21 bp, Amaranthus sp.
aagctgcatttggaaaggtct

SEQ ID NO: 2176 - DNA, 21 bp, Amaranthus sp.
aagctcatgagatcaaaaaag

SEQ ID NO: 2177 - DNA, 21 bp, Amaranthus sp.
aagcctagcagcaatggcggt

SEQ ID NO: 2178 - DNA, 21 bp, Amaranthus sp.
aagcaggctacttgcaatgta

SEQ ID NO: 2179 - DNA, 21 bp, Amaranthus sp.
aagattagggctggtcttggt

SEQ ID NO: 2180 - DNA, 21 bp, Amaranthus sp.
aagagtgaagatgaacttgcg

SEQ ID NO: 2181 - DNA, 21 bp, Amaranthus sp.
aagagggtcctaatagtttcc

SEQ ID NO: 2182 - DNA, 21 bp, Amaranthus sp.
aagagaatctgcagcaacatc

SEQ ID NO: 2183 - DNA, 21 bp, Amaranthus sp.
aagaccagccctaatcttacc

SEQ ID NO: 2184 - DNA, 21 bp, Amaranthus sp.
aagaatttgtgcgccgtaatc

SEQ ID NO: 2185 - DNA, 21 bp, Amaranthus sp.
aactattaggaccctcttccc

SEQ ID NO: 2186 - DNA, 21 bp, Amaranthus sp.
aacctaagggccagactgttg

SEQ ID NO: 2187 - DNA, 21 bp, Amaranthus sp.
aaccggtccatcgggtgtttg

SEQ ID NO: 2188 - DNA, 21 bp, Amaranthus sp.
aaccgctttggtcctaacaga

SEQ ID NO: 2189 - DNA, 21 bp, Amaranthus sp.
aaccgccatagtaagcacagg

SEQ ID NO: 2190 - DNA, 21 bp, Amaranthus sp.
aacagtctggcccttaggttt

SEQ ID NO: 2191 - DNA, 21 bp, Amaranthus sp.
aacaggccttaatttaccatt

SEQ ID NO: 2192 - DNA, 21 bp, Amaranthus sp.
aacagaaaccggtccatcggg

SEQ ID NO: 2193 - DNA, 21 bp, Amaranthus sp.
aacacccgatggaccggtttc

SEQ ID NO: 2194 - DNA, 21 bp, Amaranthus sp.
aaattctgataaatccaaatg

SEQ ID NO: 2195 - DNA, 21 bp, Amaranthus sp.
aaatgcagctttcatactcaa

SEQ ID NO: 2196 - DNA, 21 bp, Amaranthus sp.
aaatccaaatgcgaaaggcag

SEQ ID NO: 2197 - DNA, 21 bp, Amaranthus sp.
aaagttgagtatgaaagctgc

SEQ ID NO: 2198 - DNA, 21 bp, Amaranthus sp.
aaaggtctggaccttagagca

SEQ ID NO: 2199 - DNA, 21 bp, Amaranthus sp.
aaagggtggtagtatcatcgc

SEQ ID NO: 2200 - DNA, 21 bp, Amaranthus sp.
aaaggatccaacagtctggcc

SEQ ID NO: 2201 - DNA, 21 bp, Amaranthus sp.
aaaggaagaataatcctccac

SEQ ID NO: 2202 - DNA, 21 bp, Amaranthus sp.
aaagctgcatttggaaaggtc

SEQ ID NO: 2203 - DNA, 21 bp, Amaranthus sp.
aaagctcatgagatcaaaaaa

SEQ ID NO: 2204 - DNA, 21 bp, Amaranthus sp.
aaagagtgaagatgaacttgc

SEQ ID NO: 2205 - DNA, 21 bp, Amaranthus sp.
aaactattaggaccctcttcc

SEQ ID NO: 2206 - DNA, 21 bp, Amaranthus sp.
aaacctaagggccagactgtt

SEQ ID NO: 2207 - DNA, 21 bp, Amaranthus sp.
aaaccggtccatcgggtgttt

SEQ ID NO: 2208 - DNA, 21 bp, Amaranthus sp.
aaacacccgatggaccggttt

SEQ ID NO: 2209 - DNA, 21 bp, Amaranthus sp.
aaaattctgataaatccaaat

SEQ ID NO: 2210 - DNA, 21 bp, Amaranthus sp.
aaaagggtggtagtatcatcg

SEQ ID NO: 2211 - DNA, 21 bp, Amaranthus sp.
aaaagagtgaagatgaacttg

SEQ ID NO: 2212 - DNA, 21 bp, Amaranthus sp.
aaaaattctgataaatccaaa

SEQ ID NO: 2213 - DNA, 21 bp, Amaranthus sp.
aaaaaagggaaggtccgtagg

SEQ ID NO: 2214 - DNA, 22 bp, Amaranthus palmeri
gtgatattacctccaacacgat

SEQ ID NO: 2215 - DNA, 21 bp, Amaranthus palmeri
atagtaagcacaggatcggag

SEQ ID NO: 2216 - DNA, 21 bp, Amaranthus palmeri
ctttcaatccactgtcaaccg

SEQ ID NO: 2217 - DNA, 22 bp, Amaranthus palmeri
atcaagcgttcgaagacctcat

SEQ ID NO: 2218 - DNA, 21 bp, Amaranthus palmeri
cagcaatggcggtaggtaaca

SEQ ID NO: 2219 - DNA, 21 bp, Amaranthus palmeri
gcaattgcccgaatcctttta

SEQ ID NO: 2220 - DNA, 21 bp, Amaranthus palmeri
tagctcaatatcaaggtccta

SEQ ID NO: 2221 - DNA, 21 bp, Amaranthus palmeri
tcataagcaccctctatacac

What is claimed is:

1. A method for potentiating activity of a protoporphyrinogen IX oxidase (PPG oxidase) inhibitor herbicide in a field comprising (a) applying to the surfaces of plants in the field a composition comprising at least one non-transcribable polynucleotide and a transfer agent, wherein the at least one non-transcribable polynucleotide is from 21 to about 700 nucleotides in length and is identical or complementary to at least 21 contiguous nucleotides of a protoporphyrinogen IX oxidase (PPG oxidase) gene sequence or an RNA sequence thereof, wherein the PPG oxidase gene sequence is selected from the group consisting of SEQ ID NOs: 7-12, 14, 15, 17, 20, 29-34, 36-48, 51-57, 61-75, 88, 89, 104, 105, 120-129, 132, 133, 142, 143, 146-149, 162, 163, 166-171, 174, 175, 196-423, 430, 431, 436, 437, 440-523, 534, 535, 550, 551, 556, 557, 560, 561, 564-567, 576-581, 584, 585, 594, 595, 610-613, 626, 627, 630-737, 740-743, 746-777, 780-803, 806-1281, 1284-1287, 1290-1297, 1300, 1301, 1308-1381, 1383, 1384, 1386-1388, 1390-1393, 1395-1397, 1399, 1401, 1402, 1405, 1406, 1410, 1411, 1414-1417, 1420, 1422, 1424, 1425, 1427, 1430, 1432, 1437, 1439, 1440, 1442, 1443, 1446, 1447, 1449, 1453, 1456, 1458, 1459, 1461, 1463-1465, 1467, 1468, 1472, 1473, 1477, 1479-1484, 1487, 1489, 1490, 1495, 1497, 1498, 1499, 1501-1504, 1509, 1512, 1513, 1518, 1519, 1520, 1522, 1524, 1526, 1528, 1529, 1532-1534, 1537-1541, 1545-1548, 1550, 1553, 1556, 1557, 1559, 1562, 1563, 1565, 1566, 1568, 1573, 1574, 1576, 1578-1580, 1583, 1584, 1586, 1587, 1590, 1592, 1594, 1598, 1599, 1601, 1602, 1604-1607, 1610, 1611, 1616, 1618, 1619, 1624, 1625, 1627-1629, 1632, 1633, 1635, 1636, 1639, 1641, 1644, 1647, 1648, 1651-1653, 1655-1658, 1661, 1664-1669, 1671, 1672, 1674, 1675, 1677, 1679, 1681, 1683, 1685, 1687, 1688, 1692, 1695, 1698, 1699, 1700, 1703, 1704, 1706, 1708-1710, 1713-1715, 1718, 1719, 1721, 1722, 1724, 1726-1729, 1731, 1732, 1735, 1738, 1740, 1742, 1745, 1748, 1750-1752, 1754, 1755, 1759-1763, 1765, 1766, 1768, 1772-1776, 1782, 1785-1787, 1791-1793, 1795-1797, 1801, 1802, 1804, 1805, 1808, 1810, 1811, 1815, 1820, 1823, 1825, 1826, 1829-1833, 1836-1838, 1840, 1842, 1845-1847, 1849-1852, 1854-1856, 1858, 1868-1870, 1873-1876, 1878-1880, 1883, 1885, 1886, 1891, 1893, 1895-1897, 1900, 1902, 1909, 1912-1914, 1916, 1917, 1920, 1921, 1923-1926, 1928, 1929, 1931-1933, 1936, 1939, 1940, 1944, 1946, 1950-1952, 1954, 1959, 1961-1963, 1965, 1968, 1970, 1972, 1977, 1980-1983, 1985, 1988, 1991-1995, 1997-1999, 2003, 2008-2010, 2013, 2014, 2016, 2020, 2021, 2025-2031, 2033-2035, 2038, 2040-2042, 2044, 2048, 2051-2053, 2056, 2059, 2060, 2063-2065, 2069, 2071, 2074, 2076, 2077, 2079, 2080, 2082, 2085-2087, 2093-2098, 2102-2104, 2106, 2108, 2111-2115, 2117, 2118, 2122, 2129, 2131, 2132, 2134, 2136, 2138-2140, 2142, 2147, 2152-2154, 2156, 2159, 2160, 2161, 2164, 2168, 2171, 2174, 2176, 2177, 2179-2181, 2183-2185, 2189, 2191, 2194, 2196, 2197, 2199, 2203-2205, and 2209-2213,
wherein the transfer agent conditions the surfaces of the plants in the field for permeation by the at least one non-transcribable polynucleotide, and
(b) applying the PPG oxidase inhibitor herbicide to the plants in the field;
whereby the at least one non-transcribable polynucleotide permeates the interior of the plants and induces suppression of a PPG oxidase gene, thereby potentiating activity of the PPG oxidase inhibitor herbicide in the plants.

2. The method of claim 1, wherein
the at least one non-transcribable polynucleotide is selected from the group consisting of a sense single-stranded DNA (ssDNA), an anti-sense ssDNA, a sense single-stranded RNA (ssRNA), an anti-sense ssRNA, a double-stranded RNA (dsRNA), a double-stranded DNA (dsDNA), and a dsDNA/RNA hybrid; or the composition comprises two or more of the at least one non-transcribable polynucleotides.

3. The method of claim 1, wherein the transfer agent is an organosilicone surfactant composition or an organosilicone compound contained therein.

4. The method of claim 1, wherein the composition further comprises the PPG oxidase inhibitor herbicide.

5. The method of claim 4, wherein the PPG oxidase inhibitor herbicide is selected from the group consisting of acifluorfen-Na, bifenox, chlomethoxyfen, chlornitrofen, ethoxyfen-ethtyl, fluoroglycofen-ethyl, fomesafen, halosafen, lactofen, oxyfluorfen, fluazolate, pyraflufen-ethyl, cinidon-ethyl, flumioxazin, flumiclorac-pentyl, fluthiacet-methyl, thidiazimin, oxadiazon, oxadiargyl, pyraclonil, flufenpyr-ethyl, azafenidin, carfentrazone-ethyl, saflufenacil, sulfentrazone, pentoxazone, benzfendizone, butafenacil, pyrazogyl, and profluazol.

6. The method of claim 4, wherein the composition further comprises one or more herbicides different from the PPG oxidase inhibitor herbicide.

7. The method of claim 4, wherein the composition further comprises a co-herbicide.

8. The method of claim 7, wherein the co-herbicide is selected from the group consisting of amide herbicides, arsenical herbicides, benzothiazole herbicides, benzoylcyclohexanedione herbicides, benzofuranyl alkylsulfonate herbicides, cyclohexene oxime herbicides, cyclopropylisoxazole herbicides, dicarboximide herbicides, dinitroaniline herbicides, dinitrophenol herbicides, dithiocarbamate herbicides, glycine herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazolone herbicides, triazolopyrimidine herbicides, uracil herbicides, and urea herbicides.

9. The method of claim 4, wherein the composition further comprises a pesticide.

10. The method of claim 9, wherein the pesticide is selected from the group consisting of insecticides, fungicides, nematicides, bactericides, acaricides, growth regulators, chemosterilants, semiochemicals, repellents, attractants, pheromones, feeding stimulants, and biopesticides.

11. The method of claim 1, wherein the plants are selected from the group consisting of *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Chenopodium album, Commelina diffusa, Conyza canadensis, Digitaria sanguinalis, Euphorbia heterophylla, Kochia scoparia*, and *Lolium multiflorum.*

12. A method of reducing growth, development, or reproductive ability in a plant, comprising treating the surfaces of a plant in a field with a composition comprising a PPG oxidase inhibitor herbicide in combination with (a) at least one non-transcribable polynucleotide that is from 21 to about 700 nucleotides in length and is identical or complementary to at least 21 contiguous nucleotides of a PPG oxidase gene sequence or an RNA sequence thereof, wherein the PPG oxidase gene sequence is selected from the group consisting of SEQ ID NOs: 7-12, 14, 15, 17, 20, 29-34, 36-48, 51-57, 61-75, 88, 89, 104, 105, 120-129, 132, 133, 142, 143, 146-149, 162, 163, 166-171, 174, 175, 196-423, 430, 431, 436, 437, 440-523, 534, 535, 550, 551, 556, 557, 560, 561, 564-567, 576-581, 584, 585, 594, 595, 610-613, 626, 627, 630-737, 740-743, 746-777, 780-803, 8006-1281, 1284-1287, 1290-1297, 1300, 1301, 1308-1381, 1383, 1384, 1386-1388, 1390-1393, 1395-1397, 1399, 1401, 1402,1405, 1406, 1410, 1411, 1414-1417, 1420, 1422, 1424, 1425, 1427, 1430, 1432, 1437, 1439, 1440, 1442, 1443, 1446, 1447, 1449, 1453, 1456, 1458, 1459, 1461, 1463-1465, 1467, 1468, 1472, 1473, 1477, 1479-1484, 1487, 1489, 1490, 1495, 1497, 1498, 1499, 1501-1504, 1509, 1512, 1513, 1518, 1519, 1520, 1522, 1524, 1526, 1528, 1529, 1532-1534, 1537-1541, 1545-1548, 1550, 1553, 1556, 1557, 1559, 1562, 1563, 1565, 1566, 1568, 1573, 1574, 1576,1578-1580, 1583, 1584, 1586, 1587, 1590, 1592, 1594, 1598, 1599, 1601, 1602, 1604-1607, 1610, 1611, 1616, 1618, 1619, 1624, 1625, 1627-1629, 1632, 1633, 1635, 1636, 1639, 1641, 1644, 1647, 1648, 1651-1653, 1655-1658, 1661, 1664-1669, 1671, 1672, 1674, 1675, 1677, 1679, 1681, 1683, 1685, 1687, 1688, 1692, 1695, 1698, 1699, 1700, 1703, 1704, 1706, 1708-1710, 1713-1715, 1718, 1719, 1721, 1722, 1724, 1726-1729, 1731, 1732, 1735, 1738, 1740, 1742, 1745, 1748, 1750-1752, 1754, 1755, 1759-1763, 1765, 1766, 1768, 1772-1776, 1782, 1785-1787, 1791-1793, 1795-1797, 1801, 1802, 1804, 1805, 1808, 1810, 1811, 1815, 1820, 1823, 1825, 1826, 1829-1833, 1836-1838, 1840, 1842, 1845-1847, 1849-1852, 1854-1856, 1858, 1868-1870, 1873-1876, 1878-1880,1883, 1885, 1886, 1891, 1893, 1895-1897, 1900, 1902, 1909, 1912-1914, 1916, 1917, 1920, 1921, 1923-1926, 1928, 1929, 1931-1933, 1936, 1939, 1940, 1944, 1946, 1950-1952, 1954, 1959, 1961-1963, 1965, 1968, 1970, 1972, 1977, 1980-1983, 1985, 1988, 1991-1995, 1997-1999, 2003, 2008-2010, 2013, 2014, 2016, 2020, 2021, 2025-2031, 2033-2035, 2038, 2040-2042, 2044, 2048, 2051-2053, 2056, 2059, 2060, 2063-2065, 2069, 2071, 2074, 2076, 2077, 2079, 2080, 2082, 2085-2087, 2093-2098, 2102-2104, 2106, 2108, 2111-2115, 2117, 2118, 2122, 2129, 2131, 2132, 2134, 2136, 2138-2140, 2142, 2147, 2152-2154, 2156, 2159, 2160, 2161, 2164, 2168, 2171, 2174, 2176, 2177, 2179-2181, 2183-2185, 2189, 2191, 2194, 2196, 2197, 2199, 2203-2205, and 2209-2213, and (b) an organosilicone surfactant, whereby growth, development, or reproductive ability is reduced in the treated plant compared to a control plant treated with the PPG oxidase inhibitor herbicide alone.

13. The method of claim 12, wherein
the at least one non-transcribable polynucleotide is selected from the group consisting of a sense ssDNA, an anti-sense ssDNA, a sense ssRNA, an anti-sense ssRNA, a dsRNA, a dsDNA, and a dsDNA/RNA hybrid; or
the composition comprises two or more of the at least one non-transcribable polynucleotides.

14. The method of claim 12, wherein the PPG oxidase inhibitor herbicide is selected from the group consisting of acifluorfen-Na, bifenox, chlomethoxyfen, chlornitrofen, ethoxyfen-ethtyl, fluoroglycofen-ethyl, fomesafen, halosafen, lactofen, oxyfluorfen, fluazolate, pyraflufen-ethyl, cinidon-ethyl, flumioxazin, flumiclorac-pentyl, fluthiacet-methyl, thidiazimin, oxadiazon, oxadiargyl, pyraclonil, flufenpyr-ethyl, azafenidin, carfentrazone-ethyl, saflufenacil, sulfentrazone, pentoxazone, benzfendizone, butafenacil, pyrazogyl, and profluazol.

15. The method of claim 12, wherein the composition further comprises a co-herbicide or a pesticide.

16. The method of claim 12, wherein the plant is selected from the group consisting of *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Chenopodium album, Commelina diffusa, Conyza canadensis, Digitaria sanguinalis, Euphorbia heterophylla, Kochia scoparia,* and *Lolium multiflorum.*

17. The method of claim 1, wherein the PPG oxidase gene sequence is selected from the group consisting of SEQ ID NOs: 72-75, 88, 89, 104, 105, 120-129, 132, 133, 142, 143, 146-149, 162, 163, 168-171, 174, 175, 430, 431, 522, 523, 534, 535, 550, 551, 556, 557, 560, 561, 564-567, 576-581, 584, 585, 594, 595, 610-613, 626, 627, 734-737, 740-743, 746-751, 1383-1384, 1386-1388, 1390-1393, 1395-1397, 1399, 1401-1402, 1405-1406, 1410-1411, 1414-1417, 1420, 1422, 1424-1425, 1427, 1430, 1432, 1437, 1439-1440, 1442-1443, 1446-1447, 1449, 1453, 1456, 1458, 1459, 1461, 1463-1465, 1467, 1468, 1472, 1473, 1477, 1479-1484, 1487, 1489-1490, 1495, 1497-1499, 1501-1504, 1509, 1512, 1513, 1518-1520, 1522, 1524, 1526, 1528, 1529, 1532-1534, 1537-1541, 1545-1548, 1550, 1553, 1556, 1557, 1559, 1562, 1563, 1565, 1566, 1568, 1573, 1574, 1576, 1578-1580, 1583, 1584, 1586, 1587, 1590, 1592, 1594, 1598, 1599, 1601, 1602, 1604-1607, 1610, 1611, 1616, 1618, 1619, 1624, 1625, 1627-1629, 1632, 1633, 1635, 1636, 1639, 1641, 1644, 1647, 1648, 1651-1653, 1655-1658, 1661, 1664-1669, 1671, 1672, 1674, 1675, 1677, 1679, 1681, 1683, 1685, 1687, 1688, 1692, 1695, 1698-1700, 1703, 1704, 1706, 1708-1710, 1713-1715, 1718, 1719, 1721, 1722, 1724, 1726-1729, 1731, 1732, 1735, 1738, 1740, 1742, 1745, 1748, 1750-1752, 1754, 1755, 1759-1763, 1765, 1766, 1768, 1772-1776, 1782, 1785-1787, 1791-1793, 1795-1797, 1801, 1802, 1804, 1805, 1808, 1810, 1811, 1815, 1820, 1823, 1825, 1826, 1829-1833, 1836-1838, 1840, 1842, 1845-1847, 1849-1852, 1854-1856, 1858, 1868-1870, 1873-1876, 1878-1880, 1883, 1885, 1886, 1891, 1893, 1895-1897, 1900, 1902, 1909, 1912-1914, 1916, 1917, 1920, 1921, 1923-1926, 1928, 1929, 1931-1933, 1936, 1939, 1940, 1944, 1946, 1950-1952, 1954, 1959, 1961-1963, 1965, 1968, 1970, 1972, 1977, 1980-1983, 1985, 1988, 1991-1995, 1997-1999, 2003, 2008-2010, 2013, 2014, 2016, 2020, 2021, 2025, 2031, 2033-2035, 2038, 2040-2042, 2044, 2048, 2051-2053, 2056, 2059, 2060, 2063-2065, 2069, 2071, 2074, 2076, 2077, 2079, 2080, 2082, 2085-2087, 2093-2098, 2102-2104, 2106, 2108, 2111-2115, 2117, 2118, 2122, 2129, 2131, 2132, 2134, 2136, 2138-2140, 2142, 2147, 2152-2154, 2156, 2159-2161, 2164, 2168, 2171, 2174, 2176, 2177, 2179-2181, 2183-2185, 2189, 2191, 2194, 2196-2197, 2199, 2203-2205, and 2209-2213.

18. The method of claim 1, wherein the transfer agent is a surfactant.

19. The method of claim 1, wherein the applying the PPG oxidase inhibitor herbicide to the plants of step (b) is at least one day after the applying to the surface of the plants the composition of step (a).

* * * * *